US010059750B2

(12) United States Patent
Davis et al.

(10) Patent No.: US 10,059,750 B2
(45) Date of Patent: Aug. 28, 2018

(54) MODIFIED TOXINS

(71) Applicant: Angelica Therapeutics, Inc., Emeryville, CA (US)

(72) Inventors: Claude Geoffrey Davis, Auburn, CA (US); Deepshikha Datta, San Francisco, CA (US); Matthew Paul Baker, Suffolk (GB); Alyson Jane Rust, Suffolk (GB); Simon Keen, Cambridge (GB)

(73) Assignee: ANGELICA THERAPEUTICS, INC., Auburn, CA (US)

( * ) Notice: Subject to any disclaimer, the term of this patent is extended or adjusted under 35 U.S.C. 154(b) by 0 days.

(21) Appl. No.: 14/770,763

(22) PCT Filed: Mar. 11, 2014

(86) PCT No.: PCT/US2014/023761
§ 371 (c)(1),
(2) Date: Aug. 26, 2015

(87) PCT Pub. No.: WO2014/150600
PCT Pub. Date: Sep. 25, 2014

(65) Prior Publication Data
US 2016/0009768 A1 Jan. 14, 2016

Related U.S. Application Data

(60) Provisional application No. 61/799,910, filed on Mar. 15, 2013.

(51) Int. Cl.
| | | |
|---|---|---|
| *C07K 14/34* | (2006.01) |
| *A61K 39/39* | (2006.01) |
| *A61K 38/16* | (2006.01) |
| *A61K 38/20* | (2006.01) |
| *A61K 39/395* | (2006.01) |
| *A61K 45/06* | (2006.01) |
| *C07K 14/55* | (2006.01) |
| *C07K 16/32* | (2006.01) |
| *A61K 39/00* | (2006.01) |

(52) U.S. Cl.
CPC ............ *C07K 14/34* (2013.01); *A61K 38/164* (2013.01); *A61K 38/2013* (2013.01); *A61K 39/39* (2013.01); *A61K 39/3955* (2013.01); *A61K 39/39558* (2013.01); *A61K 45/06* (2013.01); *C07K 14/55* (2013.01); *C07K 16/32* (2013.01); *A61K 2039/585* (2013.01); *C07K 2317/24* (2013.01); *C07K 2317/622* (2013.01); *C07K 2317/73* (2013.01); *C07K 2319/55* (2013.01)

(58) Field of Classification Search
None
See application file for complete search history.

(56) References Cited

U.S. PATENT DOCUMENTS

| | | |
|---|---|---|
| 4,472,509 A | 9/1984 | Gansow et al. |
| 4,751,180 A | 6/1988 | Cousens et al. |
| 4,830,962 A | 5/1989 | Gelfand et al. |
| 4,894,443 A | 1/1990 | Greenfield et al. |
| 4,935,233 A | 6/1990 | Bell et al. |
| 4,938,948 A | 7/1990 | Ring et al. |
| 5,021,236 A | 6/1991 | Gries et al. |
| 5,338,542 A | 8/1994 | Thorpe |
| 5,391,377 A | 2/1995 | Barnwell |
| 5,601,827 A | 2/1997 | Collier et al. |
| 5,616,482 A | 4/1997 | Williams |
| 5,635,599 A | 6/1997 | Pastan et al. |
| 5,668,255 A | 9/1997 | Murphy |
| 5,677,148 A | 10/1997 | Williams |
| 5,695,983 A | 12/1997 | Miller et al. |
| 5,703,029 A | 12/1997 | Crass et al. |
| 5,703,039 A | 12/1997 | Williams et al. |
| 5,763,250 A | 6/1998 | Williams et al. |
| 5,785,973 A | 7/1998 | Bixler et al. |
| 5,792,458 A | 8/1998 | Johnson et al. |
| 5,843,462 A | 12/1998 | Conti-Fine |
| 5,843,711 A | 12/1998 | Collier et al. |

(Continued)

FOREIGN PATENT DOCUMENTS

| | | |
|---|---|---|
| EP | 0239400 A2 | 9/1987 |
| EP | 0438310 A1 | 7/1991 |

(Continued)

OTHER PUBLICATIONS

Branden et al. (Introduction to Protein Structure, Garland Publishing Inc., New York, p. 247, 1991).*
Houghten et al (Vaccines 86:21-25, 1986).*
McGuinness et al (Mol. Microbiol, 7:505-514, 1993).*
European Patent Application No. 2968450 extended European Search Report dated Sep. 26, 2016.
Japanese Patent Application No. 2015-195872 Office Action dated Aug. 30, 2016.
Abi-Habib et al., "A urokinase-activated recombinant diphtheria toxin targeting the granulocyte-macrophage colony-stimulating factor is selectively cytotoxic to human acute myeloid leukemia blasts," Blood, 104(7):2143-2148 (2004).
Attia, P. et al., "Inability of a Fusion Protein of IL-2 and diphtheria Toxin (denileukin Diftitox, DAB389IL-2, ONTAK) to Eliminate Regulatory T Lymphocytes in Patients with Melanoma," J. Immunotherapy 28(6):582-592 (2005).
Bacha et al., "Organ-Specific Binding of a Thyrotropin-Releasing Hormone-Diphtheria Toxin Complex after Intravenous Administration to Rats," Endocrinology, 113(3):1072-1076 (1983).

(Continued)

*Primary Examiner* — Patricia Duffy
(74) *Attorney, Agent, or Firm* — Wilson Sonsini Goodrich & Rosati

(57) ABSTRACT

The present application relates to compositions of modified toxins exhibiting cytotoxicity and/or reduced immunogenicity. Also provided are polypeptide toxophores from a modified diphtheria toxin, where modifications are in at least one amino acid residue of at least one T-cell epitope. Another aspect relates to a fusion protein which comprises a modified diphtheria toxin and a non-diphtheria toxin fragment that is a cell binding portion. Another aspect relates to the use of a modified diphtheria toxin for the treatment of a malignant disease or a non-malignant disease. A modified diphtheria toxin or fusion protein may be administered with one or more other agents.

8 Claims, 22 Drawing Sheets
Specification includes a Sequence Listing.

(56) References Cited

U.S. PATENT DOCUMENTS

| | | | |
|---|---|---|---|
| 5,856,122 A | 1/1999 | Read et al. | |
| 5,863,891 A | 1/1999 | Williams et al. | |
| 5,917,017 A | 6/1999 | Collier et al. | |
| 5,932,471 A | 8/1999 | Williams et al. | |
| 5,965,406 A | 10/1999 | Murphy | |
| 5,976,806 A | 11/1999 | Mahajan et al. | |
| 6,011,002 A | 1/2000 | Pastan et al. | |
| 6,022,950 A | 2/2000 | Murphy | |
| 6,090,930 A | 7/2000 | Wallace et al. | |
| 6,149,919 A | 11/2000 | Domenighini et al. | |
| 6,566,500 B1 | 5/2003 | Vitetta et al. | |
| 6,960,652 B2 | 11/2005 | Vitetta et al. | |
| 6,992,174 B2 | 1/2006 | Gillies et al. | |
| 7,115,725 B2 | 10/2006 | Collier | |
| 7,430,476 B2 | 9/2008 | Carr et al. | |
| 7,431,720 B2 | 10/2008 | Pendekanti et al. | |
| 7,452,971 B2 | 11/2008 | Vitetta et al. | |
| 7,585,942 B2 | 9/2009 | Harrison et al. | |
| 7,601,814 B2 | 10/2009 | Gillies et al. | |
| 7,829,668 B2 | 11/2010 | Vitetta et al. | |
| 2002/0197278 A1 | 12/2002 | Allison | |
| 2003/0143193 A1 | 7/2003 | Vitetta et al. | |
| 2003/0147895 A1 | 8/2003 | Shone et al. | |
| 2003/0153043 A1 | 8/2003 | Carr et al. | |
| 2004/0009148 A1 | 1/2004 | Vitetta et al. | |
| 2004/0062749 A1 | 4/2004 | Carr et al. | |
| 2004/0063634 A1 | 4/2004 | Carr et al. | |
| 2004/0063917 A1 | 4/2004 | Carr et al. | |
| 2004/0071688 A1 | 4/2004 | Carr et al. | |
| 2004/0072219 A1 | 4/2004 | Carr et al. | |
| 2004/0072291 A1 | 4/2004 | Carr et al. | |
| 2004/0076991 A1 | 4/2004 | Carr et al. | |
| 2004/0082039 A1 | 4/2004 | Gillies et al. | |
| 2004/0087503 A1 | 5/2004 | Carr et al. | |
| 2004/0092717 A1 | 5/2004 | Carr et al. | |
| 2004/0096442 A1 | 5/2004 | Carr et al. | |
| 2004/0120958 A1 | 6/2004 | Bander et al. | |
| 2004/0121443 A1 | 6/2004 | Carr et al. | |
| 2004/0180386 A1 | 9/2004 | Carr et al. | |
| 2004/0185038 A1 | 9/2004 | Carr et al. | |
| 2004/0213791 A1 | 10/2004 | Bander et al. | |
| 2004/0230380 A1 | 11/2004 | Chirino et al. | |
| 2004/0254106 A1 | 12/2004 | Carr et al. | |
| 2004/0256304 A1 | 12/2004 | Perry | |
| 2004/0260069 A1 | 12/2004 | Hellendoorn et al. | |
| 2005/0009119 A1 | 1/2005 | Georges et al. | |
| 2005/0020494 A1 | 1/2005 | Carr et al. | |
| 2005/0054052 A1 | 3/2005 | Carr et al. | |
| 2005/0074863 A1 | 4/2005 | Hellendoorn et al. | |
| 2005/0118169 A1 | 6/2005 | Bartke et al. | |
| 2005/0152898 A1 | 7/2005 | Carr et al. | |
| 2005/0153872 A1 | 7/2005 | Qiu | |
| 2005/0176028 A1 | 8/2005 | Hofmeister et al. | |
| 2005/0181459 A1 | 8/2005 | Baker et al. | |
| 2005/0208041 A1 | 9/2005 | Cardarelli et al. | |
| 2005/0222392 A1 | 10/2005 | Carter et al. | |
| 2005/0238642 A1 | 10/2005 | Baker et al. | |
| 2005/0240009 A1 | 10/2005 | Carr et al. | |
| 2005/0256304 A1 | 11/2005 | Jones et al. | |
| 2006/0002932 A1 | 1/2006 | Vieweg | |
| 2006/0018885 A1 | 1/2006 | Ildstad | |
| 2006/0018903 A1 | 1/2006 | Hellendoorn et al. | |
| 2006/0035322 A1 | 2/2006 | Baker et al. | |
| 2006/0062761 A1 | 3/2006 | Carr et al. | |
| 2006/0100135 A1 | 5/2006 | Vitetta et al. | |
| 2006/0140929 A1 | 6/2006 | Baker et al. | |
| 2006/0159708 A1 | 7/2006 | Harrison et al. | |
| 2006/0160995 A1 | 7/2006 | Baker et al. | |
| 2006/0165687 A1 | 7/2006 | Haynes et al. | |
| 2006/0193867 A1 | 8/2006 | Qiu | |
| 2006/0228404 A1 | 10/2006 | Anderson et al. | |
| 2006/0239912 A1 | 10/2006 | Carr et al. | |
| 2006/0269514 A1 | 11/2006 | Jazieh | |
| 2006/0270600 A1 | 11/2006 | Mekada et al. | |
| 2007/0014796 A1 | 1/2007 | Carr et al. | |
| 2007/0036780 A1 | 2/2007 | Rosenblum et al. | |
| 2007/0036815 A1 | 2/2007 | Braun et al. | |
| 2009/0041797 A1 | 2/2009 | Davis et al. | |
| 2009/0118193 A1 | 5/2009 | Frevert et al. | |
| 2009/0156502 A1 | 6/2009 | Harrison et al. | |
| 2009/0221500 A1 | 9/2009 | Davis et al. | |
| 2010/0055761 A1 | 3/2010 | Seed et al. | |
| 2010/0064083 A1 | 3/2010 | Ng et al. | |
| 2012/0258126 A1 | 10/2012 | Schoeller et al. | |

FOREIGN PATENT DOCUMENTS

| | | |
|---|---|---|
| EP | 1737961 A1 | 1/2007 |
| EP | 2968450 A2 | 1/2016 |
| JP | 2004533845 A | 11/2004 |
| JP | 2016519651 A | 7/2016 |
| WO | WO-8909622 A1 | 10/1989 |
| WO | WO-9106667 A1 | 5/1991 |
| WO | WO-9113090 A1 | 9/1991 |
| WO | WO-9206117 A1 | 4/1992 |
| WO | WO-9325210 A1 | 12/1993 |
| WO | WO-9826078 A1 | 6/1998 |
| WO | WO-9852976 A1 | 11/1998 |
| WO | WO-9953038 A2 | 10/1999 |
| WO | WO-0034317 A2 | 6/2000 |
| WO | WO-0058456 A2 | 10/2000 |
| WO | WO-0140281 A2 | 6/2001 |
| WO | WO-02069232 A2 | 9/2002 |
| WO | WO-03006047 A2 | 1/2003 |
| WO | WO-2004009109 A1 | 1/2004 |
| WO | WO-2004018684 A2 | 3/2004 |
| WO | WO-2004040262 A2 | 5/2004 |
| WO | WO-2005052129 A2 | 6/2005 |
| WO | WO-2006044864 A2 | 4/2006 |
| WO | WO-2008073160 A2 | 6/2008 |
| WO | WO-2009014835 A2 | 1/2009 |
| WO | WO-2009110944 A1 | 9/2009 |
| WO | WO-2014150600 A2 | 9/2014 |

OTHER PUBLICATIONS

Bacha et al., "Thryotropin-releasing Hormone Diphtheria Toxin-related Polypeptide Conjugates," J. Biol. Chem., 258(3):1565-1570 (1983).

Bacha et al., "Systemic Toxicity of Diphtheria Toxin-Related Fragments (CRM26, CRM45), a Hormone-Toxin Hybrid Protein (TRH-CRM45), and Ricin A1(42234)," Proc. Soc. Exp. Biol. Med., 181(1):131-138 (1986).

Baluna and Vitetta, "An In Vivo Model to Study Immunotoxin-Induced Vascular Leak in Human Tissue," J. Immunother., (1999) 22(1):41-47).

Baluna and Vitetta, "Vascular leak syndrome: A side effect of immunotherapy," Immunopharmacology, 37:117-132, 1996.

Baluna et al. "Evidence for a structural motif in toxins and interleukin-2 that may be responsible for binding to epithelial cells and initiating vascular leak syndrome," PNAS USA, 96:3957-3962 (1999).

Baluna et al., "Fibronectin Inhibits the Cytotoxic Effect of Ricin A Chain on Endothelial Cells," Int. J. Immunopharmacology, 18(6-7):355-361 (1996).

Barnett et al., "Regulatory T cells in ovarian cancer: biology and therapeutic potential," Am J Reprod Immunol. 54(6):321 (2005).

Bascon, J.U., "Vascular leak syndrome: a troublesome side effect of immunotherapy," Immunopharmacology, 39(3):255 (1998).

Benoliel et al., "Actions of intrathecal diphtheria toxin-substance P fusion protein on models of persistent pain," Pain, 79(2-3):243-53 (1999).

Bishai et al., "High-Level Expression of a Proteolytically Sensitive Diphtheria Toxin Fragment in *Escherichia coli*," J Bacteriol 169(11):5140-5151 (1987).

Bowie et al. "Deciphering the message in Protein Sequences: Tolerance to Amino Acid Substitutions," Science, 1990, 247:1306-1310.

Burgess et al., "Possible Dissociation of the Heparin-Binding and Mitogenic Activities of Heparin-binding (Acidic Fibroblast)

(56) References Cited

OTHER PUBLICATIONS

Growth Factor-1 from Its Receptor-binding Activities by Site-directed Mutagenesis of a Single Lysine Residue," J. Cell Biol. 111:2129-2138 (1990).
Cawley, D., "Epidermal Growth Factor-Toxin A Chain Conjugates: EGF-Ricin A is a Potent Toxin While EGF-Diphtheria Fragment A is Nontoxic," Cell 22:563-570 (1980).
Chaudhary et al., "A recombinant single-chain immunotoxin composed of anti-Tac variable regions and a truncated diphtheria toxin," Proc. Natl. Acad. Sci. USA, 87(23):9491-9494 (1990).
Chen et al., "Diphtheria Toxin-Resistant Mutants of *Saccharomyces cerevisiae*," Mol. Cell Biol., 5(12):3357-60 (1985).
Chin and Foss, "Biologic Correlates of response and Survival in Patients with Cutaneous T-Cell Lymphoma Treated with Denileukin Diftitox," Clinical Lymphoma and Myeloma, 7(3): 199-204 (2006).
Choe et al., "The crystal structure of diphtheria toxin," Nature 357:216-222 (1992).
Clarke S.L. et al., CD4+CD25+FOXP3+ regulatory T Cells Suppress Anti-Tumor Immune Responses in Patients with Colorectal Cancer, PLoS One 1(1):e129, 1-6 (2006).
Cohen, K.A. et al., "DAB389EGF Fusion Protein Therapy of Refractory Glioblastoma Multiforme," Curr. Pharma. Biotech. 4:39-49 (2003).
Cohen, K.A. et al., "Toxicology and Pharmacokinetics of DT388IL3, a Fusion Toxin Consisting of a Truncated Diphtheria Toxin (DT388) Linked to Human Interleukin 3 (IL3), in Cynomolgus Monkeys," Leukemia and Lymphoma 45(8):1647-1656 (2004).
Collins et al., "Identification of specific residues of human interleukin 2 that affect binding to the 70-kDa subunit (p70) of the interleukin 2 receptor," PNAS USA 85:7709-7713 (1988).
Coulson, et al., "Rotavirus contains integrin ligand sequences and a disintegrin-like domain that are implicated in virus entry into cells," PNAS USA, 94(10): 5389-5494 (1997).
Curiel et al., "Specific recruitment of regulatory T cells in ovarian carcinoma fosters immune privilege and predicts reduced survival," Nat. Med. 10: 942-949 (2004).
Dang et al., "Phase II Study of Denileukin Diftitox for Relapsed/Refractory B-Cell Non-Hodgkin's Lymphoma," J. Clin. Oncol. 22: 4095-4102 (2004).
Dang et al., "Phase II trial of denileukin diftitox for relapsed/refractory T-cell non-Hodgkin lymphoma," Br. J. Haematology 136: 439-447 (2006).
Dannull et al., "Enhancement of vaccine-mediated antitumor immunity in cancer patients after depletion of regulatory T cells," J. Clin Invest. 115(12): 3623-3633 (2005).
Divenuti et al., "Delnileukin Diftitox and Hyper-CVAD in the Treatment of Human T-Cell Lymphotropic Virus 1-Associated Adult T-Cell Leukemia/Lymphoma," (2003) Clin. Lymphoma 4(3): 176-180.
Downie, G.H. et al., "Interleukin-2 Directly Increases Albumin Permeability of Bovine and Human Vascular Endothelium In Vitro," Am. J. Resp. Cell. Mol. Biol., 7(1): 58-65 (1992).
Eklund and Kuzel, "Denileukin diftitox: a concise clinical review," Expert Rev. Anticancer Ther., Feb. 2004;5(1)33-8.
Engebraaten et al., Intratumoral Immunotoxin Treatment of Human Malignant Brain Tumors in Immunodeficient Animals, Intl. J. Cancer, 97:846-852 (2002).
Engert et al., "The Emerging Role of Ricin A-Chain Immunotoxins in Leukemia and Lymphoma," In: Clinical Applications of Immunotoxins, Frankel (ed.), 2:13-33, 1997.
Entwistle et al., "De-immunized bouganin: an innovative, antibody-directed, cytotoxic payload for a safer and more efficacious treatment of cancer," [abstract] In: Proceedings of the American Association for Cancer Research; 2005; Washington, DC Philadelphia (PA): AACR: 2005, vol. 46 Abstract No. 681 [online], [Retrieved on Mar. 23, 2011] Retrieved from the internet URL: http://aacrmeetingabstracts.org/cgi/content/abstract/2005/1/161.
EP 08826518.6 Exam Report dated Aug. 29, 2011.
EP 08826518.6 Supplementary Search Report and Written Opinion dated Dec. 20, 2010.
EP 08873133.6 Communication dated Nov. 26, 2014.
EP 08873133.6 Search Report dated Oct. 14, 2011.
Epstein, A.L. et al., "Identification of a Protein Fragment of Interleukin 2 Responsible for Vasopermeability," J. National Cancer Institute 95(10):741-749 (2003).
European Patent Application No. 08826518.6 Communication dated Jun. 26, 2015.
Figgitt et al., "Deniluekin Diftitox," Am J Clin Dermatol., 1(1):67-72 (2000).
Fix, J., "Oral Controlled Release Technology for Peptides: Status and Future Prospects," Pharm Res. 13:1760-1764 (1996).
Foss et al., "A Phase-1 trial of bexarotene and denileukin diftitox in patients with relapsed or refractory cutaneous T-cell lymphoma," Blood 106(20:454-457 (2005).
Foss et al., "DAB389IL-2 (ONTAK): A Novel Fusion Toxin Therapy for Lymphoma," Clin Lymphoma 1(4):298-302 (2001).
Frankel et al, "A Phase II Study of DT Fusion Protein Denileukin Diftitox in Patients with Fludarabine-refractory Chronic Lymphocytic Leukemia," Clin. Cancer Res. 9:3555-3561 (2003).
Frankel et al., "Phase I Trial of a Novel Diphtheria Toxin/Granulocyte Macrophage Colony-stimulating Factor Fusion Protein (DT388GMCSF) for Refractory or Relapsed Acute Myeloid Leukemia," Clin Cancer Res, 8(5): 1004-1013 (2002).
Frankel et al., "Phase II Clinical Studies of Denileukin Diftitox Diphtheria Toxin Fusion Protein in Patients with Previously Treated Chronic Lymphocytic Leukemia," Cancer, 106(10): 2158-2164 (2006).
Freifelder, "Physical Biochemistry," 1982, 2nd Ed., pp. 238-246, W.H. Freeman and Co.
Friedman, et al., "Reversible Alterations in Cultured Pulmonary Artery Endothelial Cell Monolayer Morphology and Albumin Permeability Induced by Ionizing Radiation," J. Cell. Physiol., 129: 237-249 (1986).
Ghetie et al., "Evaluation of Ricin A Chain-containing Immunotoxins Directed against CD19 and CD22 Antigens on Normal and Malignant Human B-Cells as Potential Reagents for in Vivo Therapy," Cancer Res. 48:2610-2617 (1988).
Ghetie et al., "The antitumor activity of an anti-CD22 immunotoxin in SCID mice with disseminated Daudi lymphoma is enhanced by either an anti-CD19 antibody or an anti-CD19 immunotoxin," Blood. 80(9): 2315-2320 (1992).
Godkin et al., J. Immunol, 161:850-858 (1998).
Gordon et al., "Proteolycic Activation of Bacterial Toxins by Eukaryotic Cells Is Performed by Furin and Additional Cellular Proteases," Infect Immun, 63(1):82-7 (1995).
Gordon et al., "Proteolytic Activation of Bacterial Toxins: Role of Bacterial and Host Cell Proteases," Infect Immun., 62(2):333-340 (1994).
Greenfield et al., "Mutations in Diphtheria Toxin Separate Binding from Entry and Amplify Immunotoxin Selectivity," Science, 238(4826)536-539 (1987).
Greenfield et al., "Nucleotide sequence of the structural gene for diphtheria toxin carried by corynebacteriophage B," PNAS (1983) 80: 6853-6857.
Heise et al., "Autologous dendritic cells transfected with prostate-specific antigen RNA stimulate CTL responses against metastatic prostate tumors," J. Clin. Invest. 109: 409-417 (2002).
Ho V.T. et al., "Safety and efficacy of denileukin diftitox in patients with steroid-refractory acute graft-versus-host disease after allogenic hematopoietic stem cell transplantation," Blood 104(4):1224-1226 (2004).
Holmes R.K., "Biology and Molecular Epidemiology of Diphtheria Toxin and the toxGene,"J. Infect. Dis., 181 (Supp. 1): S156-S167 (2000).
Hotz et al., "Specific Targeting of Tumor Vasculature by Diphtheria Toxin-Vascular Endothelial Growth Factor Fusion Protein Reduces Angiogenesis and Growth of Pancreatic Cancer," J Gastroinest Surg., 6(2):159-66 (2002).
Hu, H.Y. et al., "The effect of helix breaking mutations in the diphtheria toxin transmembrane domain helix layers of the fusion toxin DAB(389)-IL2," Prot. Eng. 11(9): 811-817 (1998).

(56) References Cited

OTHER PUBLICATIONS

Hu, P. et al., "Generation of low-toxicity interleukin-2 fusion protein devoid of vasopermeability activity," Blood 101(12):4853-4861 (2003).
Iida et al., "Coordinate Role for Cell Surface Chondroitin Sulfate Proteoglycan and A4B1 Integrin in Mediating Melanoma Cell Adhesion to Fibronectin," J. Cell Biol. 118(2):431-444 (1992).
IN8485/DELNP/2009 Office Action dated Aug. 26, 2014.
Isaacs, J.D., "The antiglobuliln response to therapeutic antibodies," Sem. Immunol. 2:449-456 (1990).
Jonuleit et al., Induction of Interleukin 10-producing, Nonproliferating CD4+ Cells with Regulatory Properties by Repetitive Stimulation with Allogenic Immature Human Dendritic Cells,' J. Exp. Med. 192: 1213-1222 (2000).
Kagawa and Racker, "Partial Resolution of the Enzymes Catalyzing Oxidative Phosphorylation," J. Biol. Chem. 246: 5477-5487 (1971).
Kerl et al., "Regression of extranodal natural killer/T-cell lymphoma, nasal type with denileukin diftitox (Ontak) and bexarotene (Targretin): report of a case," Br. J. Dermatology, 154: 988-991 (2006).
Kern, F. et al., "T-cell epitope mapping by flow cytometry," Nature Med. 4:975-978 (1998).
Kiyokawa et al., "Protein engineering of diphtheria-toxin-related interleukin-2 fusion toxins to increase cytotoxic potency for high-affinity IL-2-receptor-bearing target cells," Protein Engineering, 4(4):463-468 (1991).
Knechtle et al., "FN18-CRM( Immunotoxin Promotes Tolerance in Primate Renal Allografts," Transplantation, 15(63):1-6 (1997).
Knechtle et al., "Primate renal transplates using immunotoxin," Surgery, 124(2): 438-446 (1998).
Kohno et al., "Characterization of Diphtheria-Toxin-Resistant Mutants Lacking Receptor Function or Containing Nonribosylatable Elongation Factor 2," Somat Cell Mol. Genet., 11(5):421-31 (1985).
Kreitman et al., "Chimeric fusion proteins—Pseudomonas exotoxin-based," Current Opin. Invest. Drugs, 2(9):1282-1293 (2001).
Kreitman et al., "Toxin-Labeled Monoclonal Antibodies," Curr. Pharma. Biotech. 2:313-325 (2001).
Kreitman, R., "Recombinant Toxins," Adv. Pharmacol., 28:193-219 (1994).
Krietman, R.J., et al., "Immunotoxins for Targeted Cancer Therapy," The AAPS Journal, 2006, vol. 8, No. 3, pp. E532-E551.
Kunzmann et al., "Flow-cytometric assessment of cellular poly(ADP-ribosylation capacity in peripheral blood lymphocytes," Immunity & Aging 3:8 (2006).
Kwok, W.W., et al., "Rapid epitope identification from complex class-II-restricted T-cell antigens," Trends in Immunol. 22:583-588 (2001).
Laske et al., "Chronic interstitial infusion of protein to primal brain: determination of drug distribution and clearance with single-photon emission computerized tomography imaging," J Neurosurg., 87:586-5941 (1997).
Laske et al., "Tumor regression with regional distribution of the targeted toxin TF-CRM107 in patients with malignant brain tumors," Nature Medicine, 3:1362-1368 (1997).
Lazar et al., "Transforming Growth Factor a: Mutation of Aspartic Acid 47 and Leucine 48 results in Different Biological Activities," (Mol. Cell Biol., 8:1247-1252, 1988).
LeMaistre, "DAB3891L-2 (Denileukin Diftitox, Ontak): Other Potential Applications," Clin. Lymphoma, 1:S37-40 (2000).
Lindstorm, A.L. et al., "An In Vitro Model for Toxin-Mediated Vascular Leak Syndrome: Ricin Toxin A Chain Increases the Permeability of Human Endothelial Cell Monolayers," Blood 90(6):2323-2334 (1997).
Litzinger et al., "IL-2 immunotoxin denileukin diftitox regulatory T cells and enhances vaccine-mediated T-cell immunity," (2007) Blood; 110(9): 3192-201.
Liu et al., "Interstitial Diphtheria Toxin-Epidermal Growth Factor Fusion Protein Therapy Produces Regressions of Subcutaneous Human Glioblastoma Multiforme Tumors in Athymic Nude Mice," Clin. Cancer Res. 11:329-334 (2005).
Liu et al., "Targeted introduction of a diphtheria toxin resistant mutation into the chromosomal EF-2 mutants," Protein Expr Purif, 30:262-274 (2003).
Mahnke, K. et al., "Depletion of CD4+CD25+ human regulatory T cells in vivo: kinetics of Treg depletion and alterations in immune functions in vivo and in vitro," Int. J. Cancer Jun. 15, 2007; 120(12):2723-33.
Makarem et al., "Competitive Binding of Vascular Cell Adhesion Molecule-1 and the HepII/IIICS Domain of Fibronectin to the Integrin α4β1," J. Biol. Chem. 269(6):4005-4011 (1994).
Maratea et al., "Deletion and fusion analysis of the phage ØX174 lysis gene E," Gene, 40:39-46, 1985.
Marshall, K.W. et al., "Role of the Polymorphic Residues in HLA-DR Molecules in Allele-Specific Binding of Peptide Ligands," J. Immunol. 152:4946-4956 (1994).
Martin et al., "A multicenter dose-escalation trial with denileukin diftitox (ONTAK, DAB389IL-2) in patients with severe psoriasis," J. Am. Acad. Dermatol., 45(6):871-881, 2001).
Matsushita et al., "Comparative methodologies of regulatory T cell depletion in a murine melanoma model," J. Immunol. Methods; 333(1-2):167-79 (2008).
McGinnis et al., "Denileukin Diftitox for the Treatment of Panniculitic Lymphoma," Arch. Dermatol. 138: 740-742 (2002).
Mishra et al., "Recombinant toxin DAB389EGF is cytotoxic to human pancreatic cancer cells," Expert Opin. Biol., 3(7):1173-1180 (2003).
Mizrahi et al., "Treatment of ovarian cancer ascites by intraperitoneal injection of diphtheria toxin A chain-H19 vector: a case report." Journal of Medical Case Reports, 2010 4:228.
Moehring et al., "In Vitro Biosynthesis of Diphthamide, Studied with Mutant Chinese Hamster Ovary Cells Resistant to Diphtheria Toxin," Mol. Cell Biol., 4(4):642-50 (1984).
Morgan et al., "Confirmation of the Activity of the Interleukin-2 Fusion Toxin Denileukin Diftitox against Chemorefractory Chronic Lymphocytic Leukemia, including Cases with Chromosome 17p Deletions and without Detectable CD25 Expression," Clin. Cancer Res. 9(10 Pt 1): 3555-3561 (2004).
Morse, M.A. et al., "Depletion of human regulatory T cells specifically enhances antigen specific immune responses to cancer vaccines," Blood Jun. 2, 2008, epub ahead of print.
Murphy et al., "Diphtheria-Toxin-Based Fusion-Protein Toxins Targeted to the Interleukin-2 Receptor: Unique Probes for Cell Biology and a New Therapeutic Agent for the Treatment of Lymphoma," Handbook of Experimental Pharmacology, 145:91-104 (2000).
Murphy, J. R. et al., "Genetic construction, expression, and melanoma-selective cytotoxicity of a diphtheria toxin-related α-melanocyte-stimulating hormone fusion protein," PNAS US.A., 83(21):8258-8262 (1986).
Naglich et al., "Expression Cloning of a Diphtheria Toxin Receptor; Identity with a Heparin-Binding EGF-like Growth Factor Precursor," Cell, 69:1051-1061 (1992).
Nowlin et al., "A Novel Cyclic Pentapeptide Inhibits αβ1 and α5β1 Integrin-mediated Cell Adhesion," J. Biol. Chem. 268(27):20352-20359 (1993).
Onizuka et al., "Tumor Rejection by in Vivo Administration of Anti-CD25 (Interleukin-2 Receptor α) Monoclonal Antibody," Cancer Res. 59: 3128-3133 (1999).
Orucevic and Lala, "NG-Nitro-L-Arginine Methyl Ester, an Inhibitor of Nitric Oxide Synthesis, Ameliorates Interleukin-2-induced Capillary Leak Syndrome in Healthy Mice," J. Immunother. Emphasis Tumor Immunol. 18(4):210-220 (1995).
O'Sullivan et al., "Characterization of the Specificity of Peptide Binding to Four DR Haplotypes," J. Immunol. 145:1799-1808 (1990).
Pastan, et al., "Immunotoxins therapy of cancer," Nature Reviews. Cancer 6(7):559-565 (2006).
Pastan, I., "Targeted therapy of cancer with recombinant immunotoxins," Biochim Biophys Acta., 24:1333(2):C1-6 (1997).
PCT/US2008/067682 Search Report dated Feb. 11, 2009.
PCT/US2008/086858 Search Report dated Jul. 20, 2009.

(56) References Cited

OTHER PUBLICATIONS

PCT/US2014/023761 International Preliminary Report on Patentability dated Sep. 24, 2015.
PCT/US2014/023761 International Search Report and Written Opinion dated Jan. 29, 2015.
Phalipon, A. et al., "Genetically engineered diphtheria toxin fusion proteins carrying the hepatitis B surface antigen," Gene 55:255-263 (1987).
Phan et al., "*Saccharomyces cerevisiae* Elongation Factor 2," J. Biol. Chem., 268(12):8665-8668 (1993).
Pickering et al., "Prevention of Smooth Muscle Cell Outgrowth from Human Atherosclerotic Plaque by a Recombinant Cytotoxin Specific for the Epidermal Growth Factor Receptor," J. Clin. Invest. 91(2):724-729 (1993).
Prados et al., "Intratumoral and intracerebral microinfusion of IL13-PE38QQR cytotoxins: phase VII study of pre- and post-resection infusions in recurrent resectable malignant glioma," Proc. ASCO, 21:69b (2002).
Puri et al., "Preclinical Development of a Recombinant Toxin Containing Circularly Permuted Interleukin 4 and Truncated Pseudomonas Exotoxin for Therapy of Malignant Astrocytoma," Cancer Research, 61:5660-5662 (1996).
Qiao et al., "PG13 Packaging Cells Produce Recombinant Retroviruses Carrying a Diphtheria Toxin Mutant Which Kills Cancer Cells," J. Virol. 76(14):7343-7348 (2002).
Rand et al., "Intratumoral Administration of Recombinant Circularly Permuted Interleukin-4-Pseudomonas Exotoxin in Patients with High-Grade Glioma," Clin. Cancer Res., 6:2157-2165 (2000).
Rasku, M.A. et al., "Transient T cell depletion causes regression of melanoma metastases," J. Translational Med. 6:1-18 (2008).
Read and Powrie, "CD4+ regulatory T cells," Curr. Opin. Immunol. 13: 644-649 (2001).
Rebello, P.R. et al., "Anti-Globulin Responses to Rat and Humanized Campath-1 Monoclonal Antibody Used to Treat Transplant Rejection," Transplantation 68:1417-1420 (1999).
Reece, J.C. et al., "Mapping the Major Human T Helper Epitopes of Tetanus Toxin," J. Immunol. 151:6175-6184 (1993).
Robadey, C. et al., "The Processing Routes Determined by Negatively Charged Residues in DR1-Restricted T Cell Determinants," J. Immunol. 159:3238-3246 (1997).
Rosconi, "Topography of Helices 5-7 in Membrane-inserted Diphtheria Toxin T Domain," J. Biol. Chem. 277(19):16517-161278 (2002).
Rosenberg et al., "A Progress Report on the Treatment of 157 Patients with Advanced Cancer Using Lymphokine-Activated Killer Cells and Interleukin-2 or High-Dose Interleukin-2 Alone," N. Engl. J. Med., 316:889-897, 1987.
Rosenstein et al., "Extravasation of Intravascular Fluid Mediated by the Systemic Administration of Recombinant Interleukin 2," J. Immunol., 137:1735-1742, 1986).
Russo, D. et al., "Neutralizing anti-interferon-α antibodies and response to treatment in patients with Ph+ chronic myeloid leukaemia sequentially treated with recombinant (α2a) and lymphoblastoid interferon-α," Br. J. Haem. 94:300-305 (1996).
Salagianni, et al., "NK Cell Adoptive Transfer Combined with Ontak-Mediated Regulatory T Cell Elimination Induces Effective Adaptive Antitumor Immune Responses." The Journal of Immunology, 2011, 186:3327-3335.
Samanen, J. et al., "Chemical Approaches to Improve the Oral Bioavailability of Peptidergic Molecules," J. Pharm. Pharmacol. 48:119 135 (1996).
Sausville and Vitetta, "Clinical Studies with Deglycosylated Ricin A-Chain Immunotoxins," In: Monoclonal Antibody-Based Therapy of Cancer, Grossbard (ed.), 4:81-89, 1997.
Schrama, D. et al., "Antibody targeted drugs as cancer therapeutics," Nature Reviews: Drug Discovery 5:147-159 (2006).
Schroff, R.W. et al., "Human Anti-Murine Immunoglobulin Responses in Patients Receiving Monoclonal Antibody Therapy," Cancer Res. 45:879-885 (1985).
Shapira et al., "Toxin-Based Therapeutic Approaches," Toxins 2,2519-2583 (2010).
Shawler, D.L. et al., "Human Immune Response to Multiple Injections of Murine Monoclonal IgG1," J. Immunol. 135:1530-1535 (1985).
Shevach, E.M., "Certified Professionals: CD4+CD5+ Suppressor T Cells," J. Exp. Med. 193(11): F41-F46 (2001).
Shimizu et al., "Induction of Tumor Immunity by Removing CD25+CD4+ T Cells: A Common Basis Between Tumor Immunity and Autoimmunity," J. Immunol. 163: 5211-5218 (1999).
Shulga-Morskoy et al., "Bioactive IL7-diphtheria fusion toxin secreted by mammalian cells," Protein Eng., Design & Selection 18(1):25-31 (2005).
Siegall et al., "Characterization of Vascular Leak Syndrome Induced by the Toxin Component of Pseudomonas Exotoxin-based Immunotoxins and Its Potential Inhibition with Nonsteroidal Anti-Inflammatory Drugs," Clin. Cancer Res. 3:339-345 (1997).
Siegall et al., "Prevention of immunotoxin-mediated vascular leak syndrome in rats with retention of antitumor activity," PNAS 91(20):9514-9518 (1994).
Silverman et al., "Mutational Analysis of the Helical Hairpin Region of Diphtheria Toxin Transmembrane Domain," J. Biol. Chem. 269(36):22524-22532 (1994.
Silverman et al., "Structure-Function Relationships in Diphtheria Toxin Channels: 1. Determining a Minimal Channel-Forming Domain," J. Membr. Biol. 137: 17-28 (1994).
Sing, A et al, Journal of Clinical Microbiology, Oct. 2003, vol. 41(10), pp. 4848-4851, Detection of Differences in the Nucleotide and Amino acid sequences of Diphtheria toxin from Corynebacterium diphtheriae and Corynebacterium ulcerans Causing Extrapharyngeal Infections.
Smallshaw et al., "Genetic engineering of an immunotoxin to eliminate pulmonary vascular leak in mice," Nat Biotechnol., 21(4):387-391 (2003).
Smallshaw et al., "Preclinical toxicity and efficacy testing of RiVax, a recombinant protein vaccine against ricin," Vaccine 23:4775-47854 (2005).
Soler-Rodriguez et al., "Ricin A-Chain and Ricin-A Chain Immunotoxins Rapidly Damage Human Endothelial Cells: Implications for Vascular Leak Syndrome," Exp. Cell Res., 206:227-234.
Steis, R. et al., "Resistance to Recombinant Interferon Alfa-2a in Hairy-Cell Leukemia Associated with Neutralizing Anti-Interferon Antibodies," New Engl. J. Med. 318:1409-1413 (1988).
Stickler, M.M. et al., "CDF+ T-Cell Epitope Determination using Unexposed Human Donor Peripheral Blood Mononuclear Cells," J. Immunotherapy 23:654-660 (2000).
Sturniolo, T. et al., "Generation of tissue-specific and promiscuous HLA ligand databases using DNA microarrays and virtual HLA class II matrices," Nat. Biotech. 17:555-561 (1999).
Su et al., "Immunological and Clinical Responses in Metastatic Renal Cancer Patients Vaccinated with Tumor RNA-transfected Dendritic Cells," Cancer Res. 63: 3127-2133 (2003).
Sugimoto et. al., "A Simple and Efficient Method for the Oligonucleotide-Directed Mutagenesis Using Plasmid DNA Template and Phosphorothioate-Modified Nucleotide," Annal. Biochem., 179(2):309-311 (1989).
Sutmuller et al. "Synergism of Cytotoxic T Lymphocyte-associated Antigen 4 Blockade and Depletion of CD25+ Regulatory T Cells in Antitumor Therapy Reveals Alternative Pathways for Suppression of Autoreactive Cytotoxic T Lymphocyte Responses," J. Exp. Med. 194(6): 823-832 (2001).
Talpur et al., "CD25 Expression Is Correlated with Histological Grade and Response to Denileukin diftitox in Cutaneous T-Cell Lymphoma," J. Investigative Dermatology 126: 575-583 (2006).
Thrush et al., Immunotoxins: An Update (abstract), Annual Review of Immunology (1996) vol. pp. 49-71 [retrieved on Mar. 23, 2011]/ Retrieved online from URL. http://www.annualreviews.org/doi/abs/10.1146.annurev.immunol.14.1.49.
U.S. Appl. No. 12/143,469 Office Action dated Apr. 4, 2012.
U.S. Appl. No. 12/143,469 Office Action dated Dec. 10, 2010.
U.S. Appl. No. 12/143,469 Office Action dated Jun. 20, 2011.
U.S. Appl. No. 12/335,297 Office Action dated Nov. 8, 2011.

(56) References Cited

OTHER PUBLICATIONS

Vallera et al., "A Bispecific Recombinant Immunotoxin, DT2219, Targeting Human CD19 and CD22 Receptors in a Mouse Xenograft Model of B-Cell Leukemia/Lymphoma," Clin. Cancer Res. 11(10);3879-3888 (2005).

Vallera et al., "Renal dysfunction accounts for the dose limiting toxicity of DT390anti-CD3sFv, a potential new recombinant anti-GVHD immunotoxin," Protein Engineering 10(9):1071-1076 (1997).

Vallera et al., "Targeting Urokinase-Type Plasminogen Activator Receptor on Human Glioblastoma Tumors With Diphtheria Toxin Fusion Protein DTAT," J Natl. Cancer Inst., 94:597-606 (2002).

vanderSpek et al, "DAB389 Interleukin-2 Receptor Binding Domain Mutations," J. Biol. Chem. 271(21):12145-12149 (1996).

vanderSpek et al., "Genetic Construction, Expression, and Characterization of Diphtheria Toxin-Based Growth Factor Fusion Proteins," Methods in Molecular Biology, Bacterial Toxins: Methods and Protocols, 145:89-99, Humana press, Totowa, N.J., (2000).

vanderSpek et al., "Maintenance of the hydrophobic face of the diphtheria toxin amphipathic transmembrane helix 1 is essential for the efficient delivery of the catalytic domain to the cytosol of target cells," Protein Eng. 7(8):985-989 (1994).

vanderSpek et al., "Structure/Function Analysis of the Transmembrane Domain of DAB389-Interleuken-2, an Interleukin-2 Receptor-targeted Fusion Toxin," J. Biol. Chem., 268(16):12077-12082 (1993).

Vitetta et al., "Immunotoxins: magic bullets or misguided missiles?" Immunology Today, 14:252-259 (1993).

Wadhwa, M. et al., "Immunogenicity of Granulocyte-Macrophage Colony-stimulating Factor (GM-CSF) Products in Patients Undergoing Combination Therapy with GM-CSF," Clin. Cancer Res. 5:1353-1361 (1999).

Walsh and Shear, "Psoriasis and the new biologic agents: interrupting a T- AP dance," CMAJ, 170(13): 1933-1941 (2004).

Wang, H. et al., "Expression, purification, and characterization of an immunotoxin containing a humanized anti-CD25 single-chain fragment variable antibody fused to a modified truncated Pseudomonas exotoxin A," Protein Expression and Purification 58(1):140-147 (2008) Abstract.

Waters et al., "DAB486IL-2(IL-2 Toxin) Selectively Inactivates High-Affinity IL-2 Receptor-Bearing Human Peripheral Blood Mononuclear Cells," Ann. New York Acad. Sci., 30(636):403-405 (1991).

Williams et al., "Cellular Processing of the Interleukin-2 Fusion Toxin DAB486-IL-2 and Efficient Delivery of Diphtheria Fragment A to the Cytosol of Target Cells Requires Arg194," J. Biol. Chem., 265 (33):20673-20677 (1990).

Williams et al., "Diphtheria toxin receptor binding domain substitution with interleukin-2: genetic construction and properties of a diphtheria toxin-related interleukin-2 fusion protein," Protein Eng., 1:493-498 (1987).

Williams et al., "Structure/Function Analysis of Interleukin-2-Toxin (DAB486-IL-2)," J. Biol. Chem., 265(20):11885-11889 (1990).

Wong, B.Y. et al., "De novo maintenance therapy with denileukin diftitox (Ontak®) in a patient with peripheral T-cell lymphoma is associated with prolonged remission," Am. J. Hematology 83:596-598 (2008).

Woo et al., "Cutting Edge: Regulatory T Cells from Lung Cancer Patients Directly Inhibit Autologous T Cell Proliferation," J. Immunol. 168: 4272-4276 (2002).

Woo et al., "Preclinical studies in rats and squirrel monkeys for safety evaluation of the bivalent anti-human T cell immunotoxin, A-demDT390-bisFv(UCHT1)," Cancer Immunol. Immunotherapy 57:1225-1239 (2008).

European Patent Application No. 08873133.6 Communication dated Aug. 3, 2017.

* cited by examiner

Cytotoxicity Assay VLS Mutants

FIG. 4

Cytotoxicity Data for VLS Variants

FIG. 15
EPITOPE VARIANTS: 7/7 IVTT DATA

MODIFIED TOXINS

CROSS-REFERENCE

This application is a § 371 national stage application of International PCT Application No. PCT/US14/23761, filed on Mar. 11, 2014, which claims the benefit of U.S. Provisional Application No. 61/799,910, filed Mar. 15, 2013, which application is incorporated herein by reference in its entirety.

This application is related to U.S. Pat. No. 8,252,897, and to U.S. Pat. No. 8,470,314, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Mar. 7, 2014, is named 33094-703.603_SL.txt and is 1,229,576 bytes in size.

BACKGROUND OF THE INVENTION

Efficacy of a therapeutic protein can be limited, for example, by an unwanted immune reaction to the therapeutic protein. For instance, several mouse monoclonal antibodies have shown promise as therapies in a number of human disease settings but in certain cases have failed due to the induction of significant degrees of a human anti-murine antibody (HAMA) response. For monoclonal antibodies, a number of techniques have been developed in attempt to reduce the HAMA response. The resultant "humanized" antibodies have, in several cases, still elicited an immune response in patients. In addition to antibodies, other therapeutic proteins of human origin and amino acid sequences can still induce an immune response in humans. Notable examples include the therapeutic use of granulocyte-macrophage colony stimulating factor.

A sustained antibody response to a therapeutic protein requires the stimulation of T-helper cell proliferation and activation. T-cell stimulation requires an interaction between a T-cell and an antigen presenting cell (APC). At the core of the interaction is the T-cell receptor (TCR) on the T-cell engaged with a peptide MHC class II complex on the surface of the APC. The peptide is derived from the intracellular processing of the antigenic protein. Peptide sequences from protein antigens that can stimulate the activity of T-cells via presentation on MHC class II molecules are generally referred to as "T-cell epitopes". Such T-cell epitopes are any amino acid residue sequence with the ability to bind to MHC Class II molecules, and which can, at least in principle, cause the activation of these T-cells by engaging a TCR to promote a T-cell response. For many proteins, T-helper cell epitopes can drive T-helper signaling to result in sustained, high affinity, class-switched antibody responses to what may be a very large repertoire of exposed surface determinants on the therapeutic protein.

Computational threading approaches to identifying polypeptide sequences with the potential to bind a sub-set of human MHC class II DR allotypes have been described. In these applications, predicted T-cell epitopes are computationally identified and subsequently removed by the use of judicious amino acid substitution within the protein of interest. However with this scheme and other computationally based procedures for epitope identification, it has been found that peptides predicted to be able to bind MHC class II molecules may not function as T-cell epitopes in all situations, particularly, in vivo due to the processing pathways or other phenomena. In addition, the computational approaches to T-cell epitope prediction have in general not been capable of predicting epitopes with DP or DQ restriction.

SUMMARY OF THE INVENTION

Provided herein are modified toxins, fusion proteins containing the modified toxins, compositions thereof, methods of making modified toxins and fusion proteins thereof, and methods of treating diseases with modified toxins.

In certain embodiments, modified toxins, fusion proteins containing the modified toxins, compositions thereof, methods of making modified toxins and fusion proteins thereof, and methods of treating diseases comprise a toxin having at least one amino acid residue modification in at least one T-cell epitope, wherein said modified toxin exhibits reduced immunogenicity compared to an unmodified toxin. In certain embodiments, modified toxins, fusion proteins containing the modified toxins, compositions thereof, methods of making modified toxins and fusion proteins thereof, and methods of treating diseases comprise a toxin having at least one amino acid residue modification in at least one T-cell epitope, wherein said modified toxin is cytotoxic compared to an unmodified toxin. In certain embodiments, modified toxins, fusion proteins containing the modified toxins, compositions thereof, methods of making modified toxins and fusion proteins thereof, and methods of treating diseases comprise a toxin having at least one amino acid residue modification in at least one T-cell epitope, wherein said modified toxin is cytotoxic and exhibits reduced immunogenicity compared to an unmodified toxin.

Provided herein are diphtheria toxins comprising the amino acid sequence as set forth in SEQ ID NO: 2, 148 or 200. Provided herein are diphtheria toxins comprising amino acid sequences about 90%, 91%, 92%, 93%, 94%, 95%, 96%, 97%, 98%, or 99% homologous to SEQ ID NO: 2, 148 or 200.

Provided herein are modified diphtheria toxins comprising at least one amino acid residue modification in at least one T-cell epitope, said modified toxins exhibiting reduced immunogenicity and/or cytotoxicity compared to unmodified toxins. In some embodiments, T-cell epitopes can comprise an amino acid sequence selected from SEQ ID NOS: 181, 184, 187, 190, 193, 196 and 199. In one embodiment of the compounds disclosed herein, at least one amino acid residue modification in a modified diphtheria toxin is made in the epitope core of SEQ ID NOS: 181, 184, 187, 190, 193, 196 and 199. In yet another embodiment, at least one amino acid residue modification is made in the N-terminus, C-terminus, or both of SEQ ID NOS: 181, 184, 187, 190, 193, 196 and 199. In still further embodiments, at least one amino acid residue modification is made in the epitope core and in the N-terminus, C-Terminus or both of SEQ ID NOS: 181, 184, 187, 190, 193, 196 and 199.

In certain embodiments, a modified diphtheria toxin or fragment thereof comprises at least one modified T-cell epitope core comprising at least one amino acid modification in a sequence selected from: (i) amino acid residue 15 of SEQ ID NO: 2 or 200; (ii) amino acid residues 97-105 of SEQ ID NO: 2 or 200; (iii) amino acid residues 107-115 of SEQ ID NO: 2 or 200; (iv) amino acid residues 116-124 of SEQ ID NO: 2 or 200; (v) amino acid residues 124-132 of SEQ ID NO: 2 or 200; (vi) amino acid residues 148-156 of SEQ ID NO: 2 or 200; and (vii) amino acid residues 298-306 of SEQ ID NO: 2 or 200. In some embodiments, a modified diphtheria toxin or fragment thereof comprises at least two modifications. In some embodiments, a modified diphtheria toxin or fragment thereof comprises at least three modifications. In some embodiments, a modified diphtheria toxin or fragment thereof comprises at least four modifications. In some embodiments, a modified diphtheria toxin or fragment thereof comprises at least five modifications. In some embodiments, a modified diphtheria toxin or fragment thereof comprises at least six modifications. In some embodiments, a modified diphtheria toxin or fragment thereof comprises at least seven modifications.

In certain embodiments, a modified diphtheria toxin or fragment thereof comprises at least one modified T-cell epitope core comprising at least one amino acid modification in a sequence selected from: (i) amino acid residue 15 of SEQ ID NO: 2, 148, or 200; (ii) amino acid residues 97-105 of SEQ ID NO: 2, 148, or 200; (iii) amino acid residues 107-115 of SEQ ID NO: 2, 148, or 200; (iv) amino acid residues 116-124 of SEQ ID NO: 2, 148, or 200; (v) amino acid residues 124-132 of SEQ ID NO: 2, 148, or 200; (vi) amino acid residues 148-156 of SEQ ID NO: 2, 148, or 200; and (vii) amino acid residues 298-306 of SEQ ID NO: 2, 148, or 200. In some embodiments, a modified diphtheria toxin or fragment thereof comprises at least two modifications. In some embodiments, a modified diphtheria toxin or fragment thereof comprises at least three modifications. In some embodiments, a modified diphtheria toxin or fragment thereof comprises at least four modifications. In some embodiments, a modified diphtheria toxin or fragment thereof comprises at least five modifications. In some embodiments, a modified diphtheria toxin or fragment thereof comprises at least six modifications. In some embodiments, a modified diphtheria toxin or fragment thereof comprises at least seven modifications.

In some embodiments, a modified diphtheria toxin or fragment thereof comprises at least one modified T-cell epitope core comprising a modification at amino acid residue 15 of SEQ ID NO: 2 or 200, and at least one amino acid modification in a sequence selected from: (i) amino acid residues 97-105 of SEQ ID NO: 2 or 200; (ii) amino acid residues 107-115 of SEQ ID NO: 2 or 200; (iii) amino acid residues 116-124 of SEQ ID NO: 2 or 200; (iv) amino acid residues 124-132 of SEQ ID NO: 2 or 200; (v) amino acid residues 148-156 of SEQ ID NO: 2 or 200; and (vi) amino acid residues 298-306 of SEQ ID NO: 2 or 200. In some embodiments, a modified diphtheria toxin or fragment thereof comprises at least two modifications. In some embodiments, a modified diphtheria toxin or fragment thereof comprises at least three modifications. In some embodiments, a modified diphtheria toxin or fragment thereof comprises at least four modifications. In some embodiments, a modified diphtheria toxin or fragment thereof comprises at least five modifications. In some embodiments, a modified diphtheria toxin or fragment thereof comprises at least six modifications. In some embodiments, a modified diphtheria toxin or fragment thereof comprises at least seven modifications.

In some embodiments, a modified diphtheria toxin or fragment thereof comprises at least one modified T-cell epitope core comprising a modification at amino acid residue 15 of SEQ ID NO: 2, 148, or 200, and at least one amino acid modification in a sequence selected from: (i) amino acid residues 97-105 of SEQ ID NO: 2, 148, or 200; (ii) amino acid residues 107-115 of SEQ ID NO: 2, 148, or 200; (iii) amino acid residues 116-124 of SEQ ID NO: 2, 148, or 200; (iv) amino acid residues 124-132 of SEQ ID NO: 2, 148, or 200; (v) amino acid residues 148-156 of SEQ ID NO: 2, 148, or 200; and (vi) amino acid residues 298-306 of SEQ ID NO: 2, 148, or 200. In some embodiments, a modified diphtheria toxin or fragment thereof comprises at least two modifications. In some embodiments, a modified diphtheria toxin or fragment thereof comprises at least three modifications. In some embodiments, a modified diphtheria toxin or fragment thereof comprises at least four modifications. In some embodiments, a modified diphtheria toxin or fragment thereof comprises at least five modifications. In some embodiments, a modified diphtheria toxin or fragment thereof comprises at least six modifications. In some embodiments, a modified diphtheria toxin or fragment thereof comprises at least seven modifications.

In some embodiments, a modified diphtheria toxin or fragment thereof comprises at least one modified T-cell epitope core comprising at least one amino acid modification in a sequence selected from: (i) amino acid residue 15 of SEQ ID NO: 2 or 200; (ii) amino acid residue 97 of SEQ ID NO: 2 or 200; (iii) amino acid residue 112 of SEQ ID NO: 2 or 200; (iv) amino acid residue 117 of SEQ ID NO: 2 or 200; (v) amino acid residue 127 of SEQ ID NO: 2 or 200; (vi) amino acid residue 148 of SEQ ID NO: 2 or 200; and (vii) amino acid residue 306 of SEQ ID NO: 2 or 200.

In some embodiments, a modified diphtheria toxin or fragment thereof comprises at least one modified T-cell epitope core comprising at least one amino acid modification in a sequence selected from: (i) amino acid residue 15 of SEQ ID NO: 2, 148, or 200; (ii) amino acid residue 97 of SEQ ID NO: 2, 148, or 200; (iii) amino acid residue 112 of SEQ ID NO: 2, 148, or 200; (iv) amino acid residue 117 of SEQ ID NO: 2, 148, or 200; (v) amino acid residue 127 of SEQ ID NO: 2, 148, or 200; (vi) amino acid residue 148 of SEQ ID NO: 2, 148, or 200; and (vii) amino acid residue 306 of SEQ ID NO: 2, 148, or 200.

In some embodiments, a modified diphtheria toxin or fragment thereof comprises at least one modified T-cell epitope core comprising a modification at amino acid residue 15 of SEQ ID NO: 2 or 200, and at least one amino acid modification in a sequence selected from: (i) amino acid residue 97 of SEQ ID NO: 2 or 200; (ii) amino acid residue 112 of SEQ ID NO: 2 or 200; (iii) amino acid residue 117 of SEQ ID NO: 2 or 200; (iv) amino acid residue 127 of SEQ ID NO: 2 or 200; (v) amino acid residue 148 of SEQ ID NO: 2 or 200; and (vi) amino acid residue 306 of SEQ ID NO: 2 or 200.

In some embodiments, a modified diphtheria toxin or fragment thereof comprises at least one modified T-cell epitope core comprising a modification at amino acid residue 15 of SEQ ID NO: 2, 148, or 200, and at least one amino acid modification in a sequence selected from: (i) amino acid residue 97 of SEQ ID NO: 2, 148, or 200; (ii) amino acid residue 112 of SEQ ID NO: 2, 148, or 200; (iii) amino acid residue 117 of SEQ ID NO: 2, 148, or 200; (iv) amino acid residue 127 of SEQ ID NO: 2, 148, or 200; (v) amino acid residue 148 of SEQ ID NO: 2, 148, or 200; and (vi) amino acid residue 306 of SEQ ID NO: 2, 148, or 200.

In some embodiments, a modified diphtheria toxin contains one or more modifications. Modifications include, but are not limited to, M15D, M15T, V29S, V29T, V29N, V29D, D30E, S31N, V97A, V97D, V97T, L107A, L107N, L107T, T112G, T112D, T112E, E113D, L115T, L115N, L115D, M116A, M116N, M116Q, E117D, T121D, T121G, T121N, T121Q, F124H, F124A, F124K, I125H, R127A, R127T, V148A, V148T, I290T, D291E, D291K, S292A, S292T, L298A, L298N, and S306G. In one embodiment, a modified diphtheria toxin contains M15T. In one embodiment, a modified diphtheria toxin contains V97T. In one embodiment, a modified diphtheria toxin contains T112D. In one embodiment, a modified diphtheria toxin contains E117D. In one embodiment, a modified diphtheria toxin contains R127A. In one embodiment, a modified diphtheria toxin contains V148T. In one embodiment, a modified diphtheria toxin contains S306G.

In some embodiments, a modified diphtheria toxin contains two modifications. Modifications include, but are not limited to, M15T V97A; M15T V97T; M15T V97D; M15T L107A; M15T L107N; M15T L107T; M15T T112G; M15T T112D; M15T T112E; M15T E113D; M15T L115T; M15T L115N; M15T L115D; M15T M116A; M15T M116N; M15T M116Q; M15T E117D; M15T T121D; M15T T121G; M15T T121N; M15T T121Q; M15T F124H; M15T F124A; M15T F124K; M15T I125H; M15T R127A; M15T R127T; M15T V148A; M15T V148T; M15T L298A; M15T L298N; and M15T S306G. In one embodiment, a modified diphtheria toxin contains M15T V97T. In one embodiment, a modified diphtheria toxin contains M15T T112D. In one embodiment, a modified diphtheria toxin contains M15T E117D. In one embodiment, a modified diphtheria toxin contains M15T R127A. In one embodiment, a modified diphtheria toxin contains M15T V148T. In one embodiment, a modified diphtheria toxin contains M15T S306G.

In some embodiments, a modified diphtheria toxin contains three modifications. Modifications include, but are not limited to, M15T V97T T112D; M15T V97T E117D; M15T V97T R127A; M15T V97T V148T; M15T V97T S306G; M15T T112D E117D; M15T T112D R127A; M15T T112D V148T; M15T T112D S306G; M15T E117D R127A; M15T E117D V148T; M15T E117D S306G; M15T R127A V148T; M15T R127A S306G; and M15T V148T S306G.

In some embodiments, a diphtheria toxin variant contains four modifications. Modifications include, but are not limited to, M15T V97T T112D E117D; M15T V97T T112D R127A; M15T V97T T112D V148T; M15T V97T T112D S306G; M15T V97T E117D R127A; M15T V97T E117D V148T; M15T V97T E117D S306G; M15T V97T R127A V148T; M15T V97T R127A S306G; M15T V97T V148T S306G; M15T T112D E117D R127A; M15T T112D E117D V148T; M15T T112D E117D S306G; M15T T112D R127A V148T; M15T T112D R127A S306G; M15T E117D R127A V148T; M15T E117D R127A S306G; M15T E117D V148T S306G; and M15T R127A V148T S306G.

In some embodiments, a diphtheria toxin variant contains five modifications. Modifications include, but are not limited to, M15T V97T T112D E117D R127A; M15T V97T T112D E117D V148T; M15T V97T T112D E117D S306G; M15T V97T E117D R127A V148T; M15T V97T E117D R127A S306G; M15T V97T R127A V148T S306G; M15T T112D E117D V148T S306G; and M15T E117D R127A V148T S306G.

In some embodiments, a diphtheria toxin variant contains six modifications. Modifications include, but are not limited to, M15T V97T T112D E117D R127A V148T; M15T V97T T112D E117D R127A S306G; M15T V97T E117D R127A V148T S306G; M15T V97T T112D R127A V148T S306G; M15T V97T T112D E117D V148T S306G; M15T V97T T112D E117D R127A S306G; and M15T T112D E117D R127A V148T S306G.

In some embodiments, a diphtheria toxin variant contains seven modifications. Modifications include, but are not limited to, M15T V97T T112D E117D R127A V148T S306G.

In some embodiments, a modified diphtheria toxin or fragment thereof comprises at least one modified T-cell epitope core comprising at least one amino acid modification in a sequence selected from: (i) M15T of SEQ ID NO: 2 or 200; (ii) V97T of SEQ ID NO: 2 or 200; (iii) T112D of SEQ ID NO: 2 or 200; (iv) E117D of SEQ ID NO: 2 or 200; (v) R127A of SEQ ID NO: 2 or 200; (vi) V148T of SEQ ID NO: 2 or 200; and (vii) S306G of SEQ ID NO: 2 or 200. In some embodiments, a modified diphtheria toxin or fragment thereof comprises at least two modifications. In some embodiments, a modified diphtheria toxin or fragment thereof comprises at least three modifications. In some embodiments, a modified diphtheria toxin or fragment thereof comprises at least four modifications. In some embodiments, a modified diphtheria toxin or fragment thereof comprises at least five modifications. In some embodiments, a modified diphtheria toxin or fragment thereof comprises at least six modifications. In some embodiments, a modified diphtheria toxin or fragment thereof comprises at least seven modifications.

In some embodiments, a modified diphtheria toxin or fragment thereof comprises at least one modified T-cell epitope core comprising a modification M15T of SEQ ID NO: 2 or 200, and at least one amino acid modification in a sequence selected from: (i) V97T of SEQ ID NO: 2 or 200; (ii) T112D of SEQ ID NO: 2 or 200; (iii) E117D of SEQ ID NO: 2 or 200; (iv) R127A of SEQ ID NO: 2 or 200; (v) V148T of SEQ ID NO: 2 or 200; and (vi) S306G of SEQ ID NO: 2 or 200. In some embodiments, a modified diphtheria toxin or fragment thereof comprises at least two modifications. In some embodiments, a modified diphtheria toxin or fragment thereof comprises at least three modifications. In some embodiments, a modified diphtheria toxin or fragment thereof comprises at least four modifications. In some embodiments, a modified diphtheria toxin or fragment thereof comprises at least five modifications. In some embodiments, a modified diphtheria toxin or fragment thereof comprises at least six modifications. In some embodiments, a modified diphtheria toxin or fragment thereof comprises at least seven modifications.

In some embodiments, a modified diphtheria toxin or fragment thereof comprises one or more modifications selected from the group consisting of M15T, V97T, T112D, E117D, R127A, V148T, S306G, and a combination thereof.

Provided herein are modified diphtheria toxin molecules containing a mutation in T cell epitope 1 either alone or in combination with a mutation in one or more of T cell epitopes 2 through 7. In one embodiment, a diphtheria toxin molecule is modified in T cell epitopes 1 and 2. In one embodiment, a diphtheria toxin molecule is modified in T cell epitopes 1 and 3. In one embodiment, a diphtheria toxin molecule is modified in T cell epitopes 1 and 4. In one embodiment, a diphtheria toxin molecule is modified in T cell epitopes 1 and 5. In one embodiment, a diphtheria toxin molecule is modified in T cell epitopes 1 and 6. In one embodiment, a diphtheria toxin molecule is modified in T cell epitopes 1 and 7.

Also provided herein is a modified diphtheria toxin molecule containing a mutation in T cell epitope 1. In one embodiment, a diphtheria toxin molecule is modified with a substitution of M by T or D at amino acid residue 15.

Also provided herein is a modified diphtheria toxin molecule containing a mutation in T cell epitope 2 either alone or in combination with a mutation in one or more of T cell epitopes 1 and/or 3-7. In one embodiment, a diphtheria toxin molecule is modified with a substitution of V by T at amino acid residue 97.

Also provided herein is a modified diphtheria toxin molecule containing a mutation in T cell epitope 3 either alone or in combination with a mutation in one or more of T cell epitopes 1, 2 and/or 4-7. In one embodiment, a diphtheria toxin molecule is modified with a substitution of T by D at amino acid residue 112.

Also provided herein is a modified diphtheria toxin molecule containing a mutation in T cell epitope 4 either alone or in combination with a mutation in one or more of T cell epitopes 1-3 and/or 5-7. In one embodiment, a diphtheria toxin molecule is modified with a substitution of E by D at amino acid residue 117.

Also provided herein is a modified diphtheria toxin molecule containing a mutation in T cell epitope 5, either alone or in combination with a mutation in one or more of T cell epitopes 1-4, 6 and/or 7. In one embodiment, a diphtheria toxin molecule is modified with a substitution of R by A at amino acid residue 127.

Also provided herein is a modified diphtheria toxin molecule containing a mutation in T cell epitope 6 either alone or in combination with a mutation in one or more of T cell epitopes 1-5 and/or 7. In one embodiment, a diphtheria toxin molecule is modified with a substitution of V by T at amino acid residue 148.

Also provided herein is a modified diphtheria toxin molecule containing a mutation in T cell epitope 7 either alone or in combination with a mutation in one or more of T cell epitopes 1-6. In one embodiment, a diphtheria toxin molecule is modified with a substitution of S by G at amino acid residue 306.

In another aspect, also provided herein is a modified diphtheria toxin molecule containing a mutation in T cell epitopes 1, 2 and 7. In yet another aspect, provided herein is a modified DT molecule containing a mutation in T cell epitopes 1, 2 and 6. In yet another aspect, provided herein is a modified DT molecule containing a mutation in T cell epitopes 1, 2 and 5. In yet another aspect, provided herein is a modified DT molecule containing a mutation in T cell epitopes 1, 2 and 4. In yet another aspect, provided herein is a modified DT molecule containing a mutation in T cell epitopes 1, 2 and 3.

Provided herein are modified toxins, including fusions containing toxins, comprising a diphtheria toxin and at least one cell binding domain of a ligand from a non-diphtheria toxin polypeptide. In one embodiment, the cell binding domain from a non-diphtheria toxin polypeptide is a cell-binding ligand. In another embodiment of the compounds disclosed herein, the modified toxin is a fusion toxin wherein a non-toxin polypeptide is a cell-binding ligand, including but not limited to an antibody or antigen-binding fragment thereof, a cytokine, a polypeptide, a hormone, a growth factor, or insulin.

In one embodiment, the modified toxin is fusion toxin wherein the cell binding domain is an antibody or antigen-binding fragment thereof. An antibody can be, for example, monoclonal, polyclonal, humanized, genetically engineered, or grafted. An antigen-binding fragment can be, for example, a Fab, Fab$_2$, F(ab')$_2$, scFv, scFv2, single chain binding polypeptide, V$_H$, or a V$_L$. In a further embodiment, the antibody or antigen binding fragment thereof binds to a B-cell surface molecule such as, for example, the B-cell surface molecule CD19 or CD22. Alternatively, the antibody or antigen binding fragment thereof, binds to the ovarian receptor MISIIR (Mullerian Inhibitory Substance type II receptor).

Non-diphtheria toxin polypeptides can comprise, but are not limited to, an antibody or antigen-binding fragment thereof, EGF, IL-1, IL-2, IL-3, IL-4, IL-5, IL-6, IL-7, IL-8, IL-9, IL-10, IL-11, IL-12, IL-13, IL-14, IL-15, INFα, INFγ, GM-CSF, G-CSF, M-CSF, TNF, VEGF, Ephrin, BFGF and TGF. In one embodiment, the cytokine is IL-2. In one embodiment, the antibody is an antibody against HER2 or HER2/neu receptor. In one embodiment, the antibody is trastuzumab.

In certain embodiments, provided herein are modified toxins having at least one amino acid residue modification in at least one T-cell epitope wherein said toxin is a diphtheria fusion toxin. Additionally provided are modified toxins having at least one amino acid residue modification in at least one T-cell epitope wherein said toxin is a diphtheria fusion toxin comprising diphtheria toxin and at least one cell binding domain from a non-diphtheria toxin polypeptide. Also provided are modified toxins having at least one amino acid residue modification in at least one T-cell epitope, wherein said toxin is a diphtheria fusion toxin comprising diphtheria toxin and at least one cell binding domain from a non-diphtheria toxin polypeptide, and wherein a non-diphtheria toxin polypeptide is IL-2. Also provided are modified toxins having at least one amino acid residue modification in at least one T-cell epitope, wherein said toxin is a diphtheria fusion toxin comprising diphtheria toxin and at least one cell binding domain from a non-diphtheria toxin polypeptide, and wherein a non-diphtheria toxin polypeptide is an antibody against HER2 receptor.

Provided herein are compositions comprising modified diphtheria toxins with reduced immunogenicity and reduced binding to endothelial cells, said modified diphtheria toxin comprising an amino acid sequence as recited in SEQ ID NO. 2, 148 or 200 with one or more amino acid modifications therein, wherein at least one T-cell epitope comprising an amino acid sequence selected from among SEQ ID NOS: 181, 184, 187, 190, 193, 196 and 199 is modified, and wherein at least one amino acid modification is made within an (x)D/E(y) motif in a region selected from among residues 7-9, 29-31 and 290-292 of SEQ ID NO 2, 148 or 200, and wherein said modified diphtheria toxin has cytotoxicity comparable to an unmodified diphtheria toxin, wherein a modification at position (x) is a substitution of V or I by an amino acid residue selected from among A, S, E, F, C, M, T, W, Y, P, H, Q, D, N, K, R, G, L and a modified or unusual amino acid from Table 1; and/or wherein a modification at position D/E is a substitution of D or E by an amino acid residue selected from among A, S, E, I, V, L, F, C, M, G, T, W, Y, P, H, Q, N, K, R and a modified or unusual amino acid from Table 1; and/or wherein a modification at position (y) is a substitution by an amino acid residue selected from among I, F, C, M, A, G, T, W, Y, P, H, E, Q, D, N, K, R, S, L, V, and a modified or unusual amino acid from Table 1.

By way of example only, unmodified diphtheria toxins can have, for example, an amino acid sequence of SEQ ID NO: 2, 148 or 200.

Compositions comprising modified diphtheria toxins exhibit (have) reduced immunogenicity (modified T-cell epitopes and/or B-cell epitopes) and reduced binding activity to human vascular endothelial cells (HUVECs) compared to an unmodified diphtheria toxin. Such compositions can further comprise a non-diphtheria toxin polypeptide including, but not limited to, an antibody or antigen-binding fragment thereof, EGF, IL-1, IL-2, IL-3, IL-4, IL-5, IL-6, IL-7, IL-8, IL-9, IL-10, IL-11, IL-12, IL-13, IL-14, IL-15, INFα, INFγ, GM-CSF, G-CSF, M-CSF, TNF, VEGF, Ephrin, BFGF and TGF. The non-diphtheria toxin polypeptide can also be a fragment of such polypeptides, such as a cell-binding portion thereof. In one embodiment, the non-diphtheria toxin polypeptide is IL-2 or a cell-binding portion thereof. In one embodiment, the non-diphtheria toxin polypeptide is an antibody against HER2 receptor or a cell-binding portion thereof.

Provided herein is a modified diphtheria toxin made by a process of (i) identifying at least one T-cell epitope within diphtheria toxin, and (ii) modifying at least one amino acid residue within at least one T-cell epitope identified in (i), wherein said modified diphtheria toxin exhibits reduced immunogenicity compared to an unmodified toxin.

Also provided herein is a method of selecting a modified diphtheria toxin exhibiting reduced immunogenicity and reduced binding to endothelial cells compared to an unmodified toxin comprising (i) identifying at least one T-cell epitope within the amino acid sequence of a diphtheria toxin of SEQ ID NO. 2, 148, or 200, (ii) modifying at least one amino acid residue within at least one T-cell epitope identified in (i), (iii) modifying at least one amino acid residue within the regions selected from the group consisting of residues 7-9, 29-31, and 290-292 of SEQ ID NO. 2, 148 or 200, wherein said modified diphtheria toxin exhibits reduced immunogenicity and reduced binding to endothelial cells compared to an unmodified toxin, (iv) analyzing the modified amino acid sequence of the modified diphtheria toxin to confirm that at least one T-cell epitope or at least one VLS motif have been modified, and (v) selecting a modified diphtheria toxin exhibiting reduced immunogenicity and reduced binding to endothelial cells compared to an unmodified toxin.

Provided herein is a method of making modified diphtheria toxin exhibiting reduced immunogenicity compared to an unmodified toxin comprising: (i) identifying at least one T-cell epitope within the amino acid sequence of a diphtheria toxin of SEQ ID NO. 2, 148 or 200; and (ii) modifying at least one amino acid residue within at least one T-cell epitope identified in (i).

Further provided herein is a method of making a modified diphtheria toxin exhibiting reduced immunogenicity and reduced binding to endothelial cells compared to an unmodified toxin comprising: (i) identifying at least one T-cell epitope within the amino acid sequence of a diphtheria toxin of SEQ ID NO. 2, 148 or 200; (ii) modifying at least one amino acid residue within at least one T-cell epitope identified in step (i); and (iii) modifying at least one amino acid residue within the regions selected from the group consisting of residues 7-9, 29-31, and 290-292 of SEQ ID NO. 2, 148 or 200, wherein said modified diphtheria toxin exhibits reduced immunogenicity and reduced binding to endothelial cells compared to an unmodified toxin.

Further provided herein is a method of making a modified diphtheria toxin exhibiting reduced immunogenicity and reduced binding to endothelial cells compared to an unmodified toxin comprising: (i) identifying at least one T-cell epitope within the amino acid sequence of a diphtheria toxin of SEQ ID NO. 2, 148 or 200; (ii) modifying at least one amino acid residue within at least one T-cell epitope identified in (i); (iii) modifying at least one amino acid residue within the regions selected from the group consisting of residues 7-9, 29-31, and 290-292 of SEQ ID NO. 2 or 200; (iv) analyzing the modified amino acid sequence of the modified diphtheria toxin to identify whether the modification of a T-cell epitope created a VLS motif; and (v) modifying said VLS motif identified in (iv), wherein said modified diphtheria toxin exhibits reduced immunogenicity and reduced binding to endothelial cells compared to an unmodified toxin.

Further provided herein is a method of making a modified diphtheria toxin exhibiting reduced immunogenicity and reduced binding to endothelial cells compared to an unmodified toxin comprising: (i) identifying at least one T-cell epitope within the amino acid sequence of a diphtheria toxin of SEQ ID NO. 2, 148 or 200; (ii) modifying at least one amino acid residue within at least one T-cell epitope identified in (i); (iii) modifying at least one amino acid residue within the regions selected from the group consisting of residues 7-9, 29-31, and 290-292 of SEQ ID NO. 2, 148 or 200; (iv) analyzing the modified amino acid sequence of the modified diphtheria toxin to identify whether the modification of a VLS motif created a T-cell epitope; and (v) modifying said T-cell epitope identified in (iv), wherein said modified diphtheria toxin exhibits reduced immunogenicity and reduced binding to endothelial cells compared to an unmodified toxin.

Modified diphtheria toxins exhibiting reduced immunogenicity and reduced binding to endothelial cells compared to an unmodified diphtheria toxin include, but are not limited to, modified diphtheria toxins having the following modification: V7N M15T V97T T112D E117D R127A V148T S306G.

Provided herein is a method of selecting a modified diphtheria toxin wherein said modified diphtheria toxin has lost at least one B-cell epitope comprising (i) obtaining a serum sample from a subject immunized with a diphtheria toxin vaccine, wherein said serum contains antibodies against said diphtheria toxin vaccine; (ii) contacting said serum with one or more modified diphtheria toxins wherein binding of said antibodies to said modified diphtheria toxin forms a complex; (iii) detecting the presence or absence of said complex, wherein if a complex is detected, the modified diphtheria toxin has not lost at least one B-cell epitope and if a reduced level of complex is detected, the modified diphtheria toxin has lost at least one B-cell epitope; and (iv) selecting a modified diphtheria toxin that has lost at least one B-cell epitope.

The present application also contemplates that modified proteins can be created in a step-wise or sequential fashion such that some modifications are made and then one or more subsequent rounds of modification(s) are made. Such sequential or step-wise modifications represent one way of carrying out the process and one way of producing the modified proteins described herein claimed herein.

Provided herein are pharmaceutical compositions, comprising a modified toxin and a pharmaceutically acceptable carrier or excipient.

Provided herein is a method for treating malignant diseases or non-malignant diseases such as GVHD in a mammal, comprising administering a therapeutically effective amount of a pharmaceutical composition described herein to said mammal.

Malignant diseases can be a blood cancer. Exemplary non-limiting blood cancers include, but are not limited to, acute myelogenous leukemia, cutaneous T-cell lymphoma, relapsed/refractory T-cell non-Hodgkin lymphoma, relapsed/refractory B-cell non-Hodgkin lymphoma, panniculitic T-cell lymphoma, extranodal natural killer/T cell lymphoma, nasal type, chronic lymphocytic leukemia, solid tumor and human T-cell lymphotrophic virus 1-associated acute T cell leukemia/lymphoma.

Malignant diseases can be a solid tumor. Malignant diseases also can be a metastasis. Exemplary solid tumors include, but are not limited to, a leiomyomas, brain tumor (e.g., a malignant, pre-malignant or benign brain tumor such as, for example, a glioblastoma, an astrocytoma, a meningioma, a medulloblastoma or a peripheral neuroectodermal tumor), a carcinoma (e.g., gall bladder carcinoma, bronchial carcinoma, basal cell carcinoma, adenocarcinoma, squamous cell carcinoma, small cell carcinoma, large cell undifferentiated carcinoma, adenomas, cystadenoma, etc.), a basalioma, a teratoma, a retinoblastoma, a choroidea melanoma, a seminoma, a sarcoma (e.g., Ewing sarcoma, rhabdomyosarcoma, craniopharyngeoma, osteosarcoma, chondrosarcoma, myosarcoma, liposarcoma, fibrosarcoma, leimyosarcoma, Askin's tumor, lymphosarcoma, neurosarcoma, Kaposi's sarcoma, dermatofibrosarcoma, angiosarcoma, etc.), a plasmocytoma, a head and neck tumor (e.g., oral, laryngeal, nasopharyngeal, esophageal, etc.), a liver tumor, a kidney tumor, a renal cell tumor, a squamous cell carcinoma, a uterine tumor, a bone tumor, a prostate tumor, a breast tumor including, but not limited to a breast tumor that is Her2- and/or ER- and/or PR-, a bladder tumor, a pancreatic tumor, an endometrium tumor, a squamous cell carcinoma, a stomach tumor, gliomas, a colorectal tumor, a testicular tumor, a colon tumor, a rectal tumor, an ovarian tumor, a cervical tumor, an eye tumor, a central nervous system tumor (e.g., primary CNS lymphomas, spinal axis tumors, brain stem gliomas, pituitary adenomas, etc.), a thyroid tumor, a lung tumor (e.g., non-small cell lung cancer (NSCLC) or small cell lung cancer), a lymphoma (e.g., cutaneous T-cell lymphomas (CTCL), non-cutaneous peripheral T-cell lymphomas, lymphomas associated with human T-cell lymphotrophic virus (HTLV) such as adult T-cell leukemia/lymphoma (ATLL), B-cell lymphoma, non-Hodgkin lymphoma, Hodgkin's lymphoma, Burkitt lymphoma, adult T-cell leukemia lymphoma, acute-myeloid leukemia (AML), chronic or hepatocellular carcinoma, etc.), a multiple myeloma, a skin tumor (e.g., basal cell carcinomas, squamous cell carcinomas, melanomas such as malignant melanomas, cutaneous melanomas or intraocular melanomas, Dermatofibrosarcoma protuberans, Merkel cell carcinoma or Kaposi's sarcoma), a gynecologic tumor (e.g., uterine sarcomas, carcinoma of the fallopian tubes, carcinoma of the endometrium, carcinoma of the cervix, carcinoma of the vagina, carcinoma of the vulva, etc.), Hodgkin's disease, a cancer of the small intestine, a cancer of the endocrine system (e.g., a cancer of the thyroid, parathyroid or adrenal glands, etc.), a mesothelioma, a cancer of the urethra, a cancer of the penis, tumors related to Gorlin's syndrome (e.g., medulloblastomas, meningioma, etc.), a tumor of unknown origin; or metastases of any thereto.

Non-malignant diseases include, for example, GVHD, aGVHD and psoriasis.

Provided herein is a method of enhancing activity of an anti-cancer agent (e.g., RNA transfected DCs, anti-CLTA4 antibodies, MISIIR scFvs, etc.), by administering a DT variant-IL2 fusion protein described herein. In one embodiment, a DT variant-IL2 fusion protein is administered followed by administration of the anti-cancer agent. In one non-limiting example, the DT variant-IL2 fusion protein is administered at least four (4) days prior to the anti-cancer agent.

Also provided herein is a method of treating a metastatic cancer via reduction or elimination of Tregs by administering an anti-cancer agent (e.g., RNA transfected DCs, anti-CLTA4 antibodies, MISIIR scFvs, etc.) and a DT variant-IL2 fusion protein described herein. Metastatic tumors include, for example, metastatic renal cell carcinoma, metastatic prostate cancer, metastatic ovarian cancer and metastatic lung cancer. In one embodiment, a DT variant-IL2 fusion protein is administered followed by administration of the anti-cancer agent. In one non-limiting example, the DT variant-IL2 fusion protein is administered at least four (4) days prior to the anti-cancer agent.

In another aspect, provided herein is a method of treating a prostate tumor, an ovarian tumor, a lung tumor or a melanoma via reduction or elimination of Tregs by administering an anti-cancer agent (e.g., RNA transfected DCs, anti-CLTA4 antibodies, MISIIR scFvs, etc.) and a DT variant-IL2 fusion protein described herein. In one embodiment, a DT variant-IL2 fusion protein is administered followed by administration of the anti-cancer agent. In one non-limiting example, the DT variant-IL2 fusion protein is administered at least four (4) days prior to the anti-cancer agent.

BRIEF DESCRIPTION OF THE DRAWINGS

FIG. 4. Provides the % maximum lysis of a variety of DT toxins that have been modified at VLS motifs compared to wild type DT. Constructs are as follows: pANG23—V7N V29T I290T; pANG33—V7N V29T; pANG35—V7N D30E I290T; pANG36—V7N V29S I290T; and pANG37—V7N V29D I290T.

| Figure legend | Mutations compared to wild type | SEQ ID NO |
|---|---|---|
| TTNAHA | V7N V97T L107N M116A F124H V148A | 544 |
| TTNQHA | V7N V97T L107N M116Q F124H V148A | 545 |
| TTNNHA | V7N V97T L107N M116N F124H V148A | 546 |
| NDNAHT | V7N V97D L107N M116A F124H V148T | 547 |
| NDNQHT | V7N V97D L107N M116Q F124H V148T | 548 |
| NDNNHT | V7N V97D L107N M116N F124H V148T | 549 |
| NTNAHT | V7N V97T L107N M116A F124H V148T | 550 |
| NTNQHT | V7N V97T L107N M116Q F124H V148T | 551 |
| NTNNHT | V7N V97T L107N M116N F124H V148T | 552 |
| TDNAHT | V7T V97D L107N M116A F124H V148T | 553 |
| TDNQHT | V7T V97D L107N M116Q F124H V148T | 554 |
| TDNNHT | V7T V97D L107N M116N F124H V148T | 555 |

Figure 15:
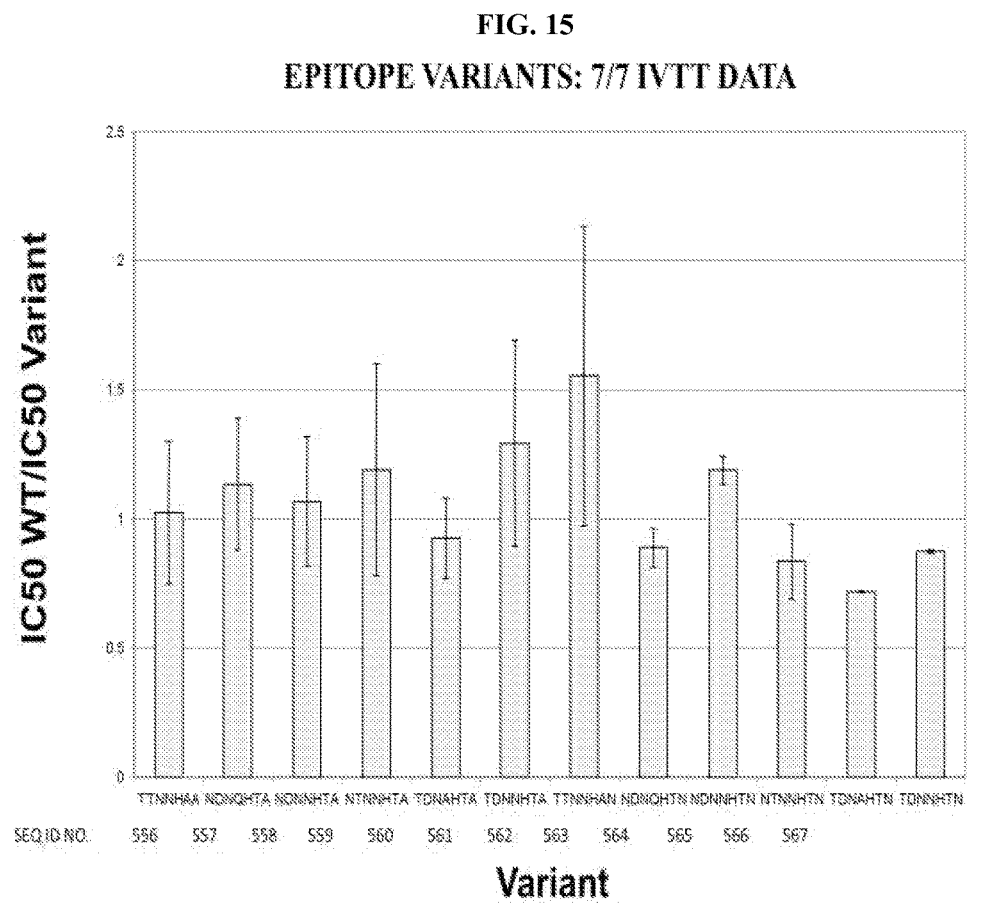

FIG. 15. Provides IVTT assays demonstrating that DT toxins containing seven modifications are active. Constructs are as follows:

| Figure legend | Mutations compared to wild type | SEQ ID NO |
|---|---|---|
| TTNNHAA | V7T V97T L107NM116NF124HV148A L298A | 556 |
| NDNQHTA | V7N V97D L107NM116NF124HV148T L298A | 557 |
| NDNNHTA | V7N V97D L107NM116NF124HV148T L298A | 558 |
| NTNNHTA | V7N V97T L107NM116NF124HV148T L298A | 559 |
| TDNAHTA | V7T V97D L107NM116AF124HV148T L298A | 560 |
| TDNNHTA | V7T V97D L107NM116NF124HV148T L298A | 561 |
| TTNNHAN | V7T V97T L107NM116NF124HV148A L298N | 562 |
| NDNQHTN | V7N V97D L107NM116QF124HV148T L298N | 563 |
| NDNNHTN | V7N V97D L107NM116NF124HV148T L298N | 564 |
| NTNNHTN | V7N V97T L107NM116NF124HV148T L298N | 565 |
| TDNAHTN | V7T V97D L107NM116AF124HV148T L298N | 566 |
| TDNNHTN | V7T V97D L107NM116NF124HV148T L298N | 567 |

Figure 16:
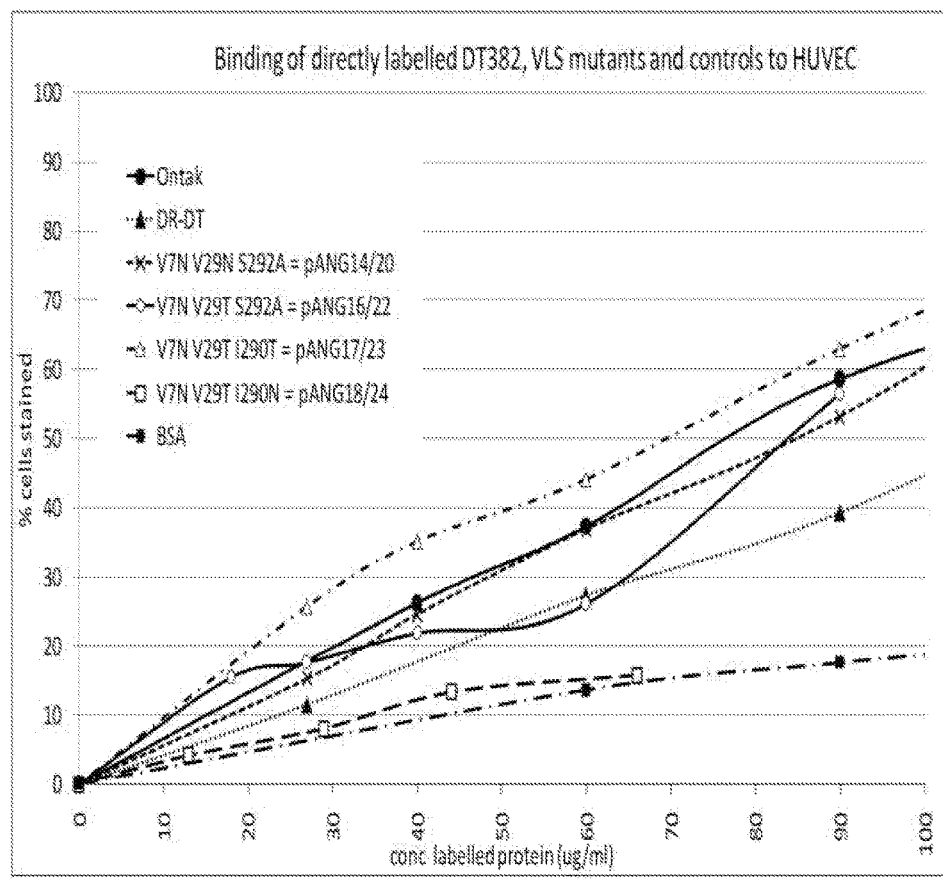

FIG. 16. Demonstrates direct binding of directly labelled DTΔR, VLS mutants and controls to HUVEC cells.

Figure 17:
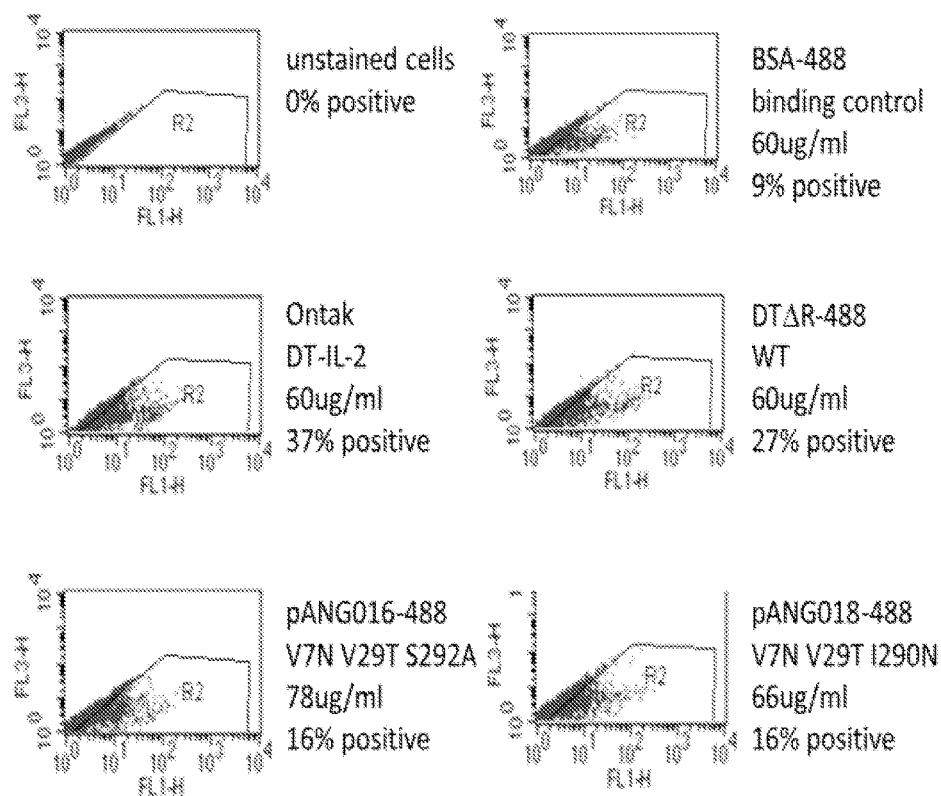

FIG. 17. Illustrates an exemplary VLS binding assay. FACS plots of Alexa-488 conjugates of Ontak, WT DTΔR and VLS mutants are provided for control and test samples.

Figure 18:
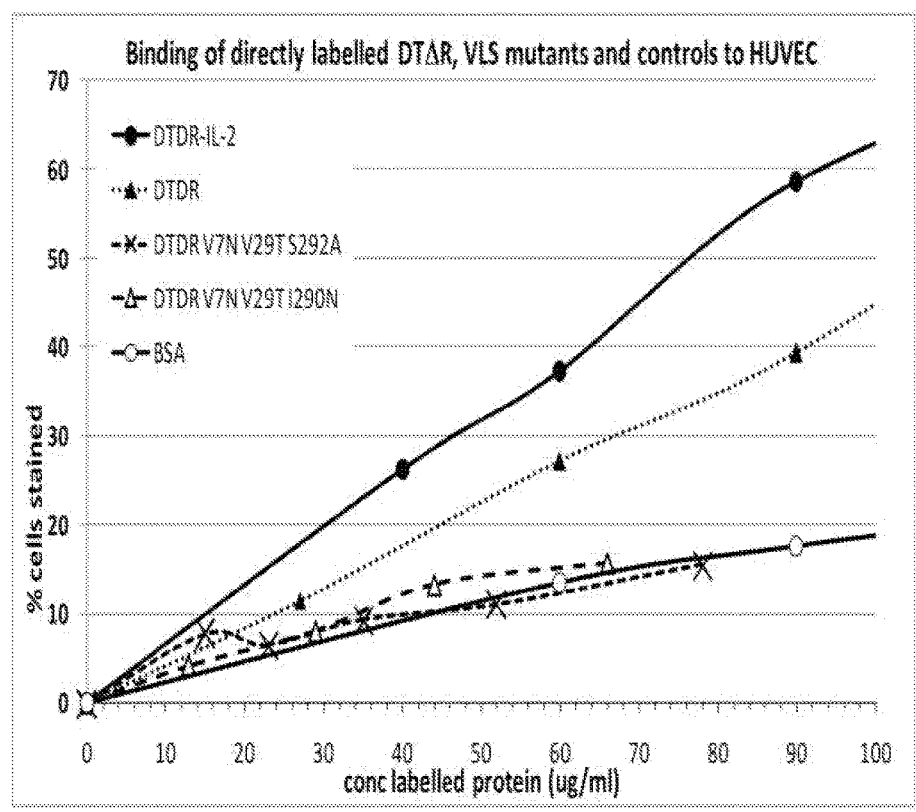

FIG. 18. Provides a graph of the scatter data presented in FIG. 17.

Figure 19:
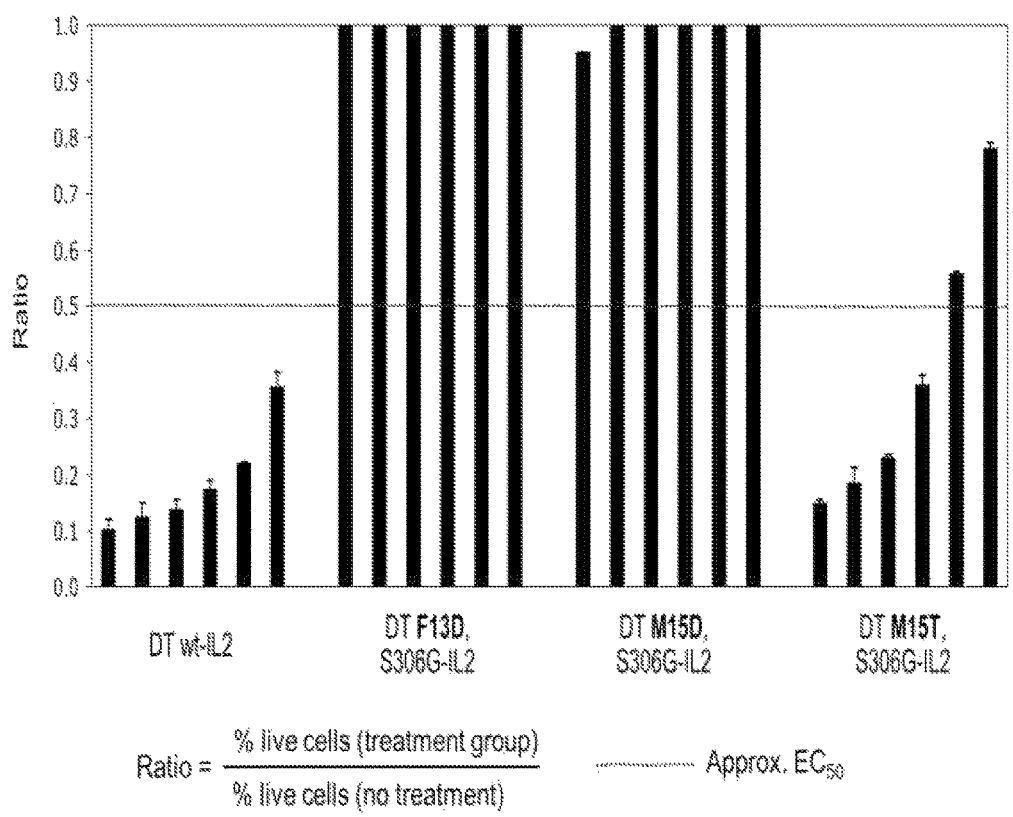

FIG. 19. Illustrates a cytotoxicity study of variants of DT-IL2 fusion protein. The data demonstrate that DT M15T, S306G-IL2 exhibited significant cytotoxicity comparable to DT wt-IL2. DT M15T, S306G-IL2 exhibited unexpectedly superior cytotoxicity than DT M15D, S306G-IL2 and DT F13D, S306G-IL2. DT-IL2 concentration, from left to right: 1. 1000 ng/ml (16.6 nM); 2. 500 ng/ml (8.32 nM); 3. 250 ng/ml (4.16 nM); 4. 125 ng/ml (2.08 nM); 5. 62.5 ng/ml (1.04 nM); 6. 31.3 ng/ml (0.52 nM).

Figure 20:
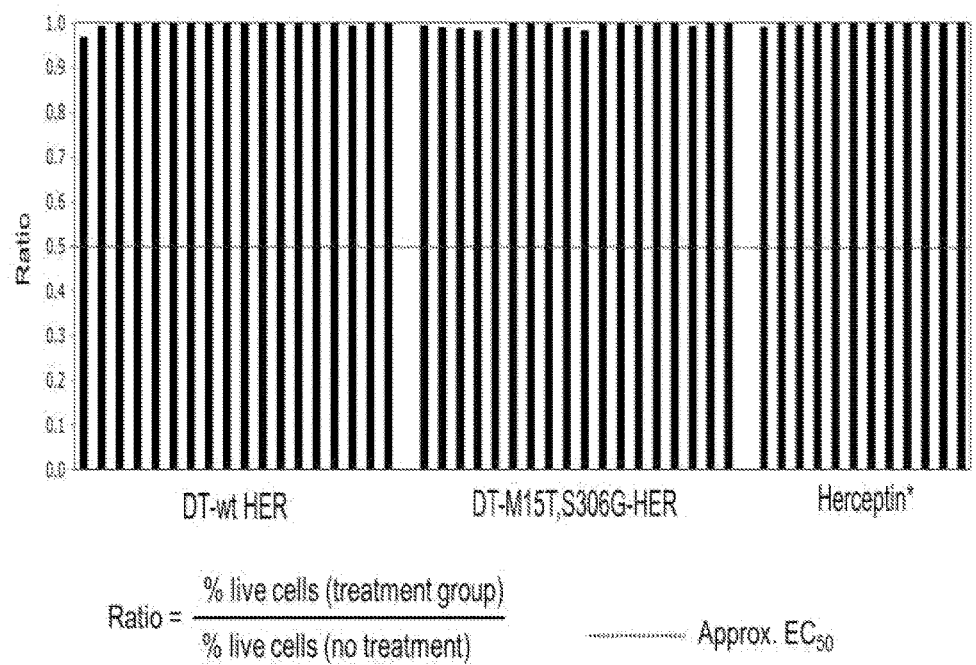

FIG. 20. Illustrates a cytotoxicity study of variants of DT-herceptin ScFv fusion protein in HER2 negative cells. The data demonstrate that none of the proteins tested exhibited cytotoxicty in MDA-MB-468 cells (HER2 negative) as expected (negative control). DT-herceptin ScFv concentration, from left to right: 1. 2500 ng/ml (34.6 nM); 2. 1250 ng/ml (17.3 nM); 3. 625 ng/ml (8.65 nM); 4. 313 ng/ml (4.33 nM); 5. 156 ng/ml (2.16 nM); 6. 78.1 ng/ml (1.08 nM); 7. 39.1 ng/ml (541 pM); 8. 19.5 ng/ml (270 pM); 9. 9.8 ng/ml (136 pM); 10. 4.9 ng/ml (67.8 pM); 11. 2.4 ng/ml (33.2 pM); 12. 1.2 ng/ml (16.6 pM); 13. 0.61 ng/ml (8.44 pM); 14. 0.31 ng/ml (4.29 pM); 15. 0.15 ng/ml (2.08 pM); 16. 0.076 ng/ml (1.05 pM); 17. 0.038 ng/ml (526 fM); 18. 0.019 ng/ml (263 fM).

Figure 21:
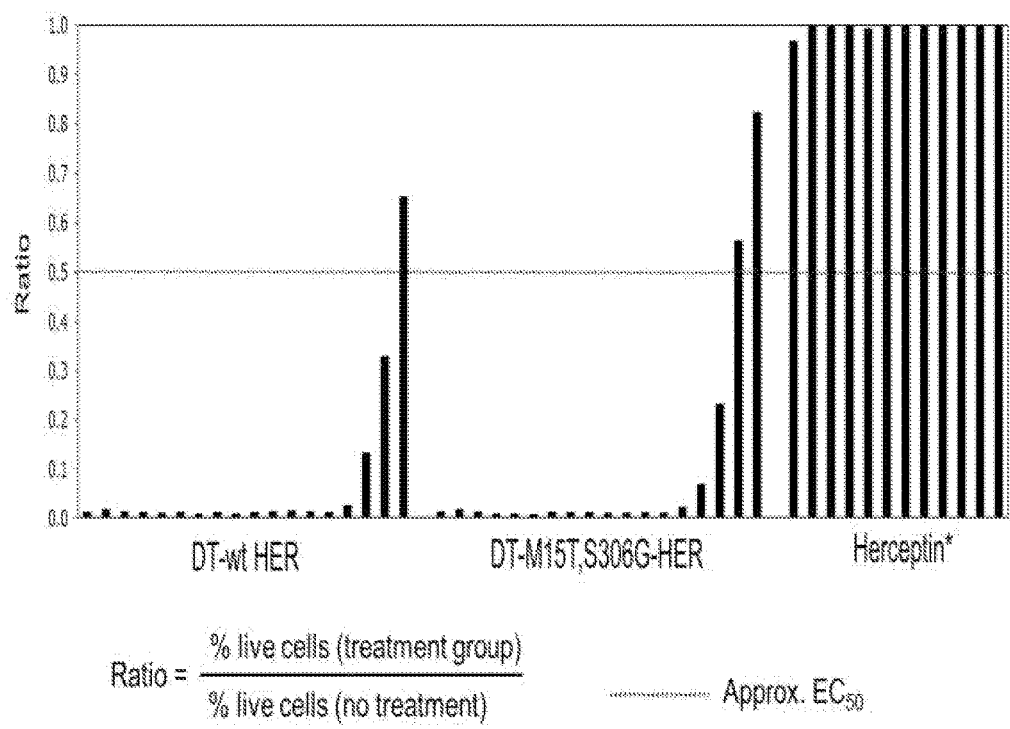

FIG. 21. Illustrates a cytotoxicity study of variants of DT-herceptin ScFv fusion protein in HER2 positive cells. The data demonstrate that DT M15T, S306G-HER exhibited significant cytotoxicity comparable to DT wt-HER. DT-herceptin ScFv concentration, from left to right: 1. 2500 ng/ml (34.6 nM); 2. 1250 ng/ml (17.3 nM); 3. 625 ng/ml (8.65 nM); 4. 313 ng/ml (4.33 nM); 5. 156 ng/ml (2.16 nM); 6. 78.1 ng/ml (1.08 nM); 7. 39.1 ng/ml (541 pM); 8. 19.5 ng/ml (270 pM); 9. 9.8 ng/ml (136 pM); 10. 4.9 ng/ml (67.8 pM); 11. 2.4 ng/ml (33.2 pM); 12. 1.2 ng/ml (16.6 pM); 13. 0.61 ng/ml (8.44 pM); 14. 0.31 ng/ml (4.29 pM); 15. 0.15 ng/ml (2.08 pM); 16. 0.076 ng/ml (1.05 pM); 17. 0.038 ng/ml (526 fM); 18. 0.019 ng/ml (263 fM).

Figure 22:
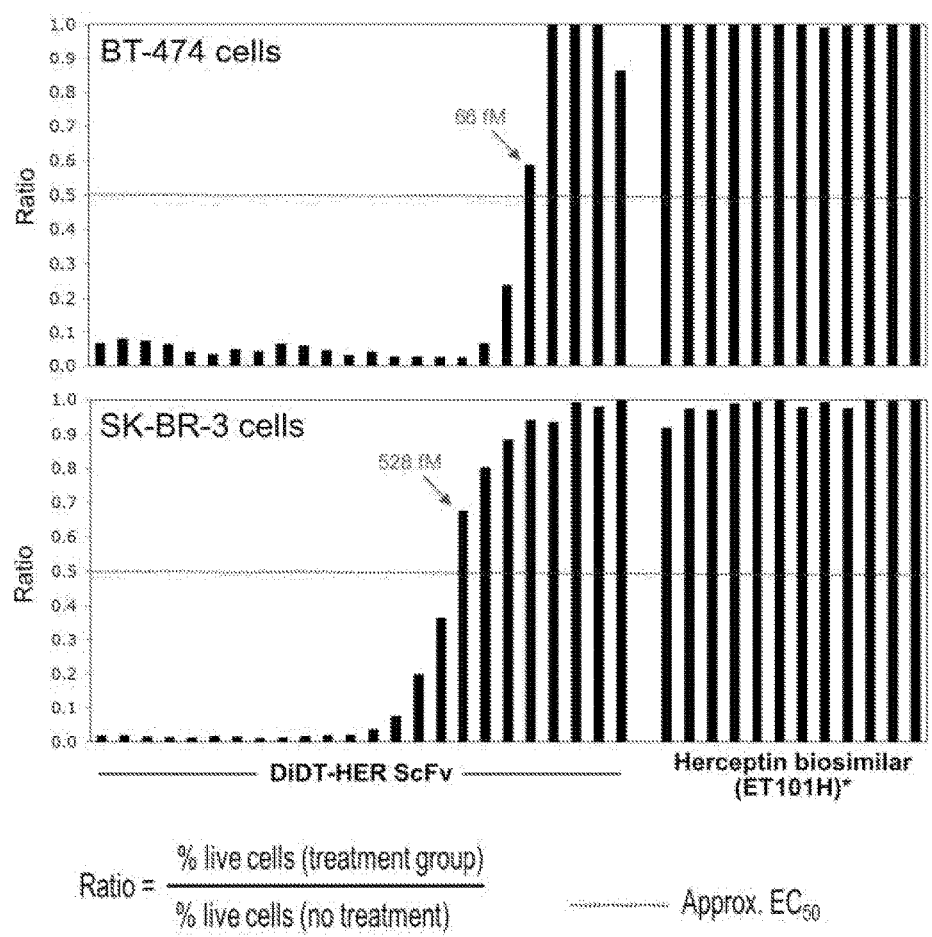

FIG. 22. Illustrates a cytotoxicity study of variants of DT-herceptin ScFv fusion protein in HER2 positive cells. The data demonstrate that DiDT-HER (DT M15T, S306G-HER) exhibited significant cytotoxicity comparable to DT wt-HER. DT-herceptin ScFv concentration, from left to right: 1. 2500 ng/ml (34.6 nM); 2. 1250 ng/ml (17.3 nM); 3. 625 ng/ml (8.65 nM); 4. 313 ng/ml (4.33 nM); 5. 156 ng/ml (2.16 nM); 6. 78.1 ng/ml (1.08 nM); 7. 39.1 ng/ml (541 pM); 8. 19.5 ng/ml (270 pM); 9. 9.8 ng/ml (135 pM); 10. 4.9 ng/ml (67.6 pM); 11. 2.4 ng/ml (33.8 pM); 12. 1.2 ng/ml (16.9 pM); 13. 0.61 ng/ml (8.45 pM); 14. 0.31 ng/ml (4.22 pM); 15. 0.15 ng/ml (2.11 pM); 16. 0.076 ng/ml (1.06 pM); 17. 0.038 ng/ml (528 fM); 18. 0.019 ng/ml (264 fM); 19. 0.0095 ng/ml (132 fM); 20. 0.0048 ng/ml (66 fM); 21. 0.0024 ng/ml (33 fM); 22. 0.0012 ng/ml (16 fM); 23. 0.0006 ng/ml (8.2 fM); 24. 0.0003 ng/ml (4.1 fM). ET101H was used at the highest twelve concentrations shown at left (from 2500 ng/ml to 1.2 ng/ml).

INCORPORATION BY REFERENCE

All publications and patent applications mentioned in this specification are herein incorporated by reference to the same extent as if each individual publication or patent application was specifically and individually indicated to be incorporated by reference.

DETAILED DESCRIPTION OF THE INVENTION

It is to be understood that this application is not limited to particular formulations or process parameters, as these may vary. It is also to be understood that the terminology used herein is for the purpose of describing particular embodiments only, and is not intended to be limiting. Further, it is understood that a number of methods and materials similar or equivalent to those described herein can be used in the practice of the present invention(s).

In accordance with the present application, there may be employed conventional molecular biology, microbiology, and recombinant DNA techniques within the skill of the art. Such techniques are explained fully in the literature. See, e.g., Sambrook et al, "Molecular Cloning: A Laboratory Manual" (1989); "Current Protocols in Molecular Biology" Volumes I-III [Ausubel, R. M., ed. (1994)]; "Cell Biology: A Laboratory Handbook" Volumes I-III [J. E. Celis, ed. (1994))]; "Current Protocols in Immunology" Volumes I-III [Coligan, J. E., ed. (1994)]; "Oligonucleotide Synthesis" (M. J. Gait ed. 1984); "Nucleic Acid Hybridization" [B. D. Hames & S. J. Higgins eds. (1985)]; "Transcription And Translation" [B. D. Hames & S. J. Higgins, eds. (1984)]; "Animal Cell Culture" [R. I. Freshney, ed. (1986)]; "Immobilized Cells And Enzymes" [IRL Press, (1986)]; B. Perbal, "A Practical Guide To Molecular Cloning" (1984), each of which is specifically incorporated herein by reference in its entirety.

I. Methods of Identifying T-Cell Epitopes

Techniques exploiting soluble complexes of recombinant MHC molecules in combination with synthetic peptides have come into use. These reagents and procedures may be used to identify the presence of T-cell clones from peripheral blood samples from human or experimental animal subjects that are able to bind particular MHC-peptide complexes and are not adapted for the screening multiple potential epitopes to a wide diversity of MHC allotypes.

Biological assays of T-cell activation remain the best practical option to providing a reading of the ability of a test peptide/protein sequence to evoke an immune response. Examples of this kind of approach include the use of T-cell proliferation assays to the bacterial protein staphylokinase, followed by epitope mapping using synthetic peptides to stimulate T-cell lines. Similarly, T-cell proliferation assays using synthetic peptides of the tetanus toxin protein have resulted in definition of immunodominant epitope regions of the toxin. In one embodiment, T-cell epitopes in a test protein may be determined using isolated sub-sets of human immune cells, promoting their differentiation in vitro and culture of the cells in the presence of synthetic peptides of interest and measurement of any induced proliferation in the cultured T-cells. Other techniques may also be used; where in both instances the method is applied to the detection of T-cell epitopes within bacterial subtilisin. Such a technique involves careful application of cell isolation techniques and cell culture with multiple cytokine supplements to obtain the desired immune cell sub-sets (dendritic cells, CD4+ and or CD8+ T-cells).

In silico techniques to define MHC class II ligands for multiple proteins of therapeutic interest may also be utilized. However, for reasons such as the requirement for proteolytic processing and other physiologic steps leading to the presentation of immunogenic peptides in vivo, a sub-set of the entire repertoire of peptides definable by computer-based schemes may have ultimate biological relevance. Thus, ex vivo human T-cell activation assays may be used to identify the regions within the protein sequence of a toxin that are able to support T-cell activation and are thereby most biologically relevant to the problem of immunogenicity in this protein. As used herein, "T-cell epitope" refers to an amino acid sequence which is able to bind MHC class II, able to stimulate T-cells and/or also to bind (without necessarily measurably activating) T-cells in complex with MHC class II.

According to a method disclosed herein, synthetic peptides are tested for their ability to evoke a proliferative response in human T-cells cultured in vitro. The T-cells are present within a peripheral blood mononuclear cell (PBMC) layer readily obtainable by well known means from whole blood samples. Moreover, the PBMC preparation contains physiological ratios of T-cells and antigen presenting cells and is, therefore, a good source of materials with which to conduct a surrogate immune reaction in vitro. In the operation of such an assay, a stimulation index approaching or exceeding 2.0 is a useful measure of induced proliferation. However, the stimulation index may be different depending upon the toxin and may be established with reference to a baseline for each toxin and corresponding peptide library. In one example of such testing, the stimulation index (SI) may be conventionally derived by division of the proliferation score (e.g. counts per minute of radioactivity if using for example $^3$H-thymidine incorporation) measured to the test peptide by the score measured in cells not contacted with a test peptide. Peptides which evoke no response may give a SI=1.0 although SI values in the range 0.8-1.2 may also be unremarkable. A number of technical procedures can be built into the operation of such assays in order to ensure confidence in the recorded scores. Typically all determinations are made at least in triplicate and the mean score may be computed. Where a computed SI=>2.0, individual scores of the triplicate can be examined for evidence of outlying data. Test peptides are contacted with cells in at least two different concentrations and the concentrations would typically span a minimum two-fold concentration difference. Such a concentration range provides an off-set to the kinetic dimension to the assay and may be useful where a single time point determination, for example at day plus 7, is being conducted. In some assays, multiple time course determinations may be conducted and these too may be made using peptide immunogen provided at a minimum of two different concentrations. Similarly the inclusion of control peptides for which there is expectation that the majority of PBMC donor samples will be responsive may be included in each assay plate. The influenza haemagglutinin peptide 307-309, sequence PKYVKQNTLKLA (SEQ ID NO: 201); and the *Chlamydia* HSP 60 peptide sequence KVVDQIKKISK-PVQH (SEQ ID NO: 202) are examples of control peptides to be used in such an assay. Alternatively, or in addition, assays could also use a potent whole protein antigen, such as hemocyanin from Keyhole Limpet, to which all PBMC samples would be expected to exhibit an SI significantly greater than 2.0. Other control antigens for such use will be well-known in the art.

The methods disclosed herein can provide an epitope map of a toxin where the map has relevance to a wide spectrum of possible MHC allotypes. The map may be sufficiently representative to allow the design or selection of a modified protein for which the ability of the protein to evoke a T-cell driven immune response may be eliminated or at least ameliorated for the majority of patients to whom the protein is likely to be administered. Amelioration can refer to a reduction in an immune response (i.e., reduced immunogenicity) compared to an unmodified protein (e.g. about 1.5 fold less, about 2 fold less, about 5 fold less, about 10 fold less, about 20 fold less, about 50 fold less, about 100 fold less, about 200 fold less, about 500 fold less or more, or any range therein). Alternatively, a protein or toxin with reduced immunogenicity can refer to a percent reduction in its ability to elicit an immune response compared to an unmodified protein (e.g. about 1% less, about 2% less, about 3% less, about 4% less, about 5% less, about 10% less, about 20% less, about 50% less, about 100% less, and any range therein). Accordingly in the practice of the screening process, PBMC derived T-cells from naive donors are collected from a pool of donors of sufficient immunological diversity to provide a sample of at least greater than 90% of the MHC class II repertoire (HLA-DR) extant in the human population. Where a naive T-cell response is to be detected to a given synthetic peptide, the peptide in practice is contacted with PBMC preparations derived from multiple donors in isolation; the numbers of donors (or "donor pool" size), is for practical purposes not likely to be less than 20 unrelated individuals and all samples in the donor pool may be pre-selected according to their MHC class II haplotype.

As used herein, the term "naive donor" refers to a subject that has not been previously exposed to a toxin, either environmentally, by vaccination, or by other means such as, for example, blood transfusions.

It is noted that individuals in certain countries are routinely vaccinated against toxins or have been exposed to environmental sources of exogenous toxin and toxin-like proteins such as, for example, diphtheria toxin. In such individuals, there is a likelihood of a recall response as measure by an increased SI score as described above.

When screening for T-cell epitopes, T-cells can be provided from a peripheral blood sample from a multiplicity of different healthy donors but who have not been in receipt of the protein therapeutically. If needed, patient blood samples can be tested for the presence of a particular polypeptide using conventional assays such as an ELISA which uses antibodies to identify the presence or absence of one or more polypeptides. The assay is conducted using PBMC cultured in vitro using conventional procedures known in the art and involves contacting the PBMC with synthetic peptide species representative of the protein of interest (i.e. a library), and following a suitable period of incubation, measurement of peptide induced T cell activation such as cellular proliferation. Measurement can be by any suitable means and may, for example, be conducted using $H^3$-thymidine incorporation whereby the accumulation of $H^3$ into cellular material is readily measured using laboratory instruments. The degree of cellular proliferation for each combination of PBMC sample and synthetic peptide can be examined relative to that seen in a non-peptide treated PBMC sample. Reference may also be made to the proliferative response seen following treatment with a peptide or peptides for which there is an expected proliferative effect. In this regard, it is advantageous to use a peptide with known broad MHC restriction and especially peptide epitopes with MHC restriction to the DP or DQ isotypes, although the invention is not limited to the use of such restricted peptides. Such peptides have been described above, for example, with respect to influenza haemagglutinin and *chlamydia* HSP60.

In one non-limiting example, T-cell epitopes for diphtheria toxin (DT) are mapped and subsequently modified using the methods described herein. To facilitate assembly of an epitope map for DT, a library of synthetic peptides is produced. Each of the peptides is 15 amino acid residues in length and each overlapped the next peptide in the series by 12 amino acid residues; i.e. each successive peptide in the series incrementally added a further 3 amino acids to the analysis. In this way, any given adjacent pair of peptides mapped 18 amino acids of contiguous sequence. One method for defining a T-cell map for DT using naive T-cell assays is illustrated in the Example 7. Each of the peptides identified via the method to define a T-cell map of the toxin are suggested to be able to bind MHC class II and engage at least one cognate TCR with sufficient affinity to evoke a proliferative burst detectable in the assay system.

II. Methods of Modifying Toxins

The toxin molecules described herein can be prepared in any of several ways including the use of recombinant methods. The protein sequences and information provided herein can be used to deduce a polynucleotide (DNA) encoding an amino acid sequence. This can be achieved for example using computer software tools such as the DNAstar software suite [DNAstar Inc, Madison, Wis., USA] or similar. Any such polynucleotide encoding the polypeptides or significant homologues, variants, truncations, elongations, or further modifications thereof, are contemplated herein.

Provided herein are methods of mapping (identifying) T-cell epitopes of toxins and modifying the epitopes such that the modified sequence reduces (partially or completely) induction of a T-helper response. Modification includes amino acid substitutions, deletions, or insertion made in codons of a polynucleotide encoding modified polypeptides to affect similar changes. Codons encoding amino acid residues are well known in the art. It is possible to use recombinant DNA methods to achieve directed mutagenesis of the target sequences and many such techniques are available, described herein, and known in the art such as described above. In general, the technique of site-specific mutagenesis is well known. Briefly, a bacteriophage vector that produces a single stranded template for oligonucleotide directed PCR mutagenesis is employed. Phage vectors (e.g. M13) are commercially available and their use is generally well known in the art. Similarly, double stranded plasmids are also routinely employed in site directed mutagenesis, which eliminates the step of transferring the polynucleotide of interest from a phage to a plasmid. Synthetic oligonucleotide primers bearing the desired mutated sequence can be used to direct the in vitro synthesis of modified (desired mutant) DNA from this template and the heteroduplex DNA is used to transform competent *E. coli* for the growth selection and identification of desired clones. Alternatively, a pair of primers can be annealed to two separate strands of a double stranded vector to simultaneously synthesize both corresponding complementary strands with the desired mutation(s) in a PCR reaction.

In one embodiment, the Quick Change site-directed mutagenesis method using plasmid DNA templates may be employed. PCR amplification of the plasmid template containing the insert target gene of insert is achieved using two synthetic oligonucleotide primers containing the desired mutation. The oligonucleotide primers, each complementary to opposite strands of the vector, are extended during temperature cycling by mutagenesis-grade PfuTurbo DNA polymerase. On incorporation of the oligonucleotide primers, a mutated plasmid containing staggered nicks is generated. Amplified un-methylated products are treated with Dpn I to digest methylated parental DNA template and select for the newly synthesized DNA containing mutations. Since DNA isolated from most *E. coli* strains is dam methylated, it is susceptible to Dpn I digestion, which is specific for methylated and hemimethylated DNA. The reaction products are transformed into high efficiency strains of *E. coli* to obtain plasmids containing the desired modifications. Additional methods for introducing amino acid modifications into a polypeptide are well known in the art and can also be used herein.

Suitable modifications to a protein may include amino acid substitution of particular residues or combinations of residues. For the elimination of T-cell epitopes, amino acid substitutions are made at appropriate points or amino acid residues within an amino acid sequence predicted to achieve reduction or elimination of the activity of the T-cell epitope. In practice, an appropriate point or amino acid residue will preferably equate to an amino acid residue binding within one of the pockets provided within the MHC class II binding groove. Such modifications may alter binding within the first pocket of the cleft at the so-called "P1" or "P1 anchor" position of the peptide. The quality of binding interaction between the P1 anchor residue of the peptide and the first pocket of the MHC class II binding groove is recognized as being a major determinant of overall binding affinity for the whole peptide. An appropriate substitution at this position of the amino acid sequence will generally incorporate an amino acid residue less readily accommodated within the pocket (e.g., substitution to a more hydrophilic residue). Amino acid residues in the peptide at positions equating to binding within other pocket regions within the MHC binding cleft are also considered and fall under the scope of the present.

It is understood that single amino acid modifications within a given potential T-cell epitope represent one route by which one or more T-cell epitopes may be eliminated. Combinations of modifications within a single epitope may be contemplated and can be appropriate where individually defined epitopes are in overlap with each other. Moreover, amino acid modifications (either singly within a given epitope or in combination within a single epitope) may be made at positions not equating to the "pocket residues" with respect to the MHC class II binding groove, but at any point within the amino acid sequence. Modifications may be made with reference to a homologous structure or structural method produced using in silico techniques known in the art and described herein may be based on known structural features of the polypeptide. A change (modification) may be contemplated to restore structure or biological activity of the variant molecule. Such compensatory changes and changes may also include deletion or addition (insertion) of particular amino acid residues from a polypeptide. Additionally, modifications can be made that alter the structure and/or reduce the biological activity of the molecule and also eliminate a T-cell epitope, thus reducing the immunogenicity of the molecule. All types of modifications are contemplated herein.

An additional means of removing epitopes from protein molecules is the concerted use of a naive T-cell activation assay scheme as outlined herein together with an in silico tool developed according to the scheme described in WO 02/069232 which is also incorporated fully herein by reference. The software simulates the process of antigen presentation at the level of the polypeptide-MHC class II binding interaction to provide a binding score for any given polypeptide sequence. Such a score is determined for many of the predominant MHC class II allotypes extant in the population. As this scheme is able to test any polypeptide sequence, the consequences of amino acid substitutions additions or deletions with respect to the ability of a polypeptide to interact with a MHC class II binding groove can be predicted. Consequently new sequence compositions can be designed which contain reduced numbers of amino acids able to interact with a MHC class II and thereby function as immunogenic T-cell epitopes. Where the biological assay using any one given donor sample can assess binding to a maximum of four DR allotypes, the in silico process can test a same polypeptide sequence using >40 allotypes simultaneously. In practice this approach is able to direct the design of new sequence variants which are altered in their ability to interact with multiple MHC allotypes. As will be clear to one in the art, multiple alternative sets of substitutions could be arrived at which achieve the objective of removing undesired epitopes. The resulting sequences would however be recognized to be closely homologous with the specific compositions disclosed herein and therefore fall within the scope of the present application.

A combined approach of using an in silico tool for the identification of MHC class II ligands and design of sequence analogues lacking MHC class II ligands, in concert with epitope mapping and re-testing optionally using biologically based assays of T-cell activation is an additional method and embodiment of the present application. The general method according to this embodiment comprises the following steps:

i) use of naive T-cell activation assays and synthetic peptides collectively encompassing the protein sequence of interest to identify epitope regions capable of activating T-cells;

ii) use of a computational scheme simulating the binding of the peptide ligand with one or more MHC allotypes to analyze the epitope regions identified in step (i) and thereby identify MHC class II ligands within the epitope region;

iii) use of a computational scheme simulating the binding of the peptide ligand with one or more MHC allotypes to identify sequence analogues of the MHC ligands encompassed within the epitope region(s) which no longer bind MHC class II or bind with lowered affinity to a lesser number of MHC allotypes and optionally, iv) use of naive T-cell activation assays and synthetic peptides encompassing entirely or in collection encompassing the epitope regions identified within the protein of interest and testing the sequence analogues in naive T-cell activation assay in parallel with the wild-type (parental) sequences.

In one embodiment, a method of making a modified toxin exhibiting reduced immunogenicity compared to an unmodified toxin comprises identifying at least one T-cell epitope within the amino acid sequence of a toxin and modifying at least one amino acid residue within at least one identified T-cell epitope.

In another embodiment, a modified toxin exhibiting reduced immunogenicity compared to an unmodified toxin is produced by a process of identifying at least one T-cell epitope within the amino acid sequence of a toxin and modifying at least one amino acid residue within at least one identified T-cell epitope.

In yet another embodiment, a method of selecting a modified toxin that exhibits reduced immunogenicity compared to an unmodified toxin comprises identifying at least one T-cell epitope within the amino acid sequence of a toxin, modifying at least one amino acid residue within at least one identified T-cell epitope, and selecting a modified toxin that exhibits reduced immunogenicity compared to an unmodified toxin.

DT T-Cell Epitopes

Also provided herein are DT variants having or containing at least one modification in one or more T-cell epitopes. Seven (7) T-cell epitopes have been identified within DT via the methods described herein and further described in Example 9. The seven T-cell epitopes comprise diphtheria toxin amino acid sequences as set forth in SEQ ID NOS: 181, 184, 187, 190, 193, 196 and 199. As described herein, SEQ ID NO: 181 corresponds to amino acid residues 1-27 of SEQ ID NO: 2, 148 or 200, SEQ ID NO: 184 corresponds to amino acid residues 85-117 of SEQ ID NO: 2, SEQ ID NO: 187 corresponds to amino acid residues 95-127 of SEQ ID NO: 2, 148 or 200, SEQ ID NO: 190 corresponds to amino acid residues 104-136 of SEQ ID NO: 2, 148 or 200, SEQ ID NO: 193 corresponds to amino acid residues 112-144 of SEQ ID NO: 2, 148 or 200, SEQ ID NO: 196 corresponds to amino acid residues 136-168 of SEQ ID NO: 2, 148 or 200, and SEQ ID NO: 199 corresponds to amino acid residues 286-318 of SEQ ID NO: 2, 148 or 200. These epitopes further comprise core 9-mer amino acid sequences that are the most favorable binding registers for MHC class II binding of the epitope (9-mer binding register) as well as adjacent amino acid residues. While the core 9-mer binding register is believed to be the primary epitope, residues located outside of the 9-mer binding register have been shown to interact with MHC class II molecules and support the stability of the peptide/MHC class II complex. The core 9-mer binding registers of the seven identified DT T-cell epitopes have the amino acid sequences of SEQ ID NOS: 161, 164, 167, 169, 173, 175, and 178.

The T-cell epitopes described herein can be further characterized by the regions of the epitope. Such regions include the epitope core, the N-terminus and the C-terminus. As used herein "epitope core" refers to the core 9-mer amino acid sequences of the T-cell epitopes. The epitope core can further include 0, 1, 2, or 3 amino acid residues adjacent to the core 9-mer amino acid sequence on the N-terminus and/or the C-terminus. Thus the epitope core, in certain embodiments, can range in length from about 9 amino acids up to about 15 amino acids.

As used herein, "N-terminus" refers to the amino acids adjacent to the N-terminus of the epitope core and includes at least 1, 2, 3, 4, 5, 6, 7, 8 or 9 amino acids adjacent to and upstream of the N-terminus of the epitope core.

As used herein, "C-terminus" refers to the amino acids adjacent to the C-terminus of the epitope core and includes at least 1, 2, 3, 4, 5, 6, 7, 8, or 9 amino acids adjacent to and downstream of the C-terminus of the epitope core.

DT T-cell epitope 1 comprises the 9-mer peptide having the amino acid sequence set forth as VDSSKSFVM (SEQ ID NO: 161). As described herein, elimination of a T-cell epitope can be achieved by modifying 0, 1, 2, 3, 4, 5, 6, 7, 8, 9, 10, 11, 12, 13, 14, or 15 amino acids of the epitope core and/or modifying 0, 1, 2, 3, 4, 5, 6, 7, 8, 9 or more of the amino acid residues adjacent to the N-terminus and/or the C-terminus of the epitope core.

In one non-limiting example, provided herein are diphtheria toxins having one or more amino acid modifications within the epitope core of DT T-cell epitope 1 having the amino acid sequence set forth as SEQ ID NO: 181, wherein the amino acid modification is by insertion, deletion, or substitution. The core epitope of DT T-cell epitope 1 can comprise amino acid residues 7-15, 6-16, 5-17, 4-18 or any combination therein of the amino acid sequence set forth as SEQ ID NO: 181. Also provided herein are diphtheria toxins having one or more amino acid modifications in the N-terminus and/or the C-terminus of DT T-cell epitope 1 having the amino acid sequence set for as SEQ ID NO: 181. The N-terminus of DT T-cell epitope 1 comprises amino acid residues 1-6, 1-5, 1-4, 1-3 or any combination therein of the amino acid sequence set forth as SEQ ID NO: 181. The C-terminus of DT T-cell epitope 1 comprises the amino acid residues 16-24, 17-25, 18-26, 19-27 or any combination therein of the amino acid sequence set forth as SEQ ID NO: 181. Further provided herein are modified diphtheria toxins having one or more amino acid modifications in the epitope core of SEQ ID NO: 181 and within the N-terminus and/or C-terminus of SEQ ID NO: 181. In one non-limiting example, the P1 valine residue of the epitope core can be replaced with any amino acid residue to modify and/or eliminate the identified T-cell epitope. In one embodiment, the P1 valine residue of the epitope core can be replaced with a polar amino acid residue such that the polar moiety of the residue is surface exposed on the DT molecule and the hydrophobic region is buried in order to modify and/or eliminate the identified T-cell epitope. Exemplary polar amino acid residues include, but are not limited to: histidine (H), glycine (G), lysine (K), serine (S), threonine (T), cysteine (C), tyrosine (Y), asparagine (N), aspartic acid/aspartate (D), glutamic acid/glutamate (E), and glutamine (Q). In one embodiment, a modification provided herein is M15T. One would understand that these modifications could be applied to the other epitopes described below.

DT T-cell epitope 2 comprises the 9-mer peptide having the amino acid sequence set forth as VDNAETIKK (SEQ ID NO: 164). Elimination of this T-cell epitope can be achieved by modifying 0, 1, 2, 3, 4, 5, 6, 7, 8, or 9 amino acids of the epitope core and/or modifying 0, 1, 2, 3, 4, 5, 6, 7, 8, 9 or more of the amino acid residues of the N-terminus and/or the C-terminus. In one non-limiting example, provided herein are diphtheria toxins having one or more amino acid modifications within the epitope core of SEQ ID NO: 184, wherein the amino acid modification is by insertion, deletion, or substitution. The core epitope of DT T-cell epitope 2 can comprise amino acid residues 13-21, 12-22, 11-23, 10-24 or any combination therein of the amino acid sequence set forth as SEQ ID NO: 184. Also provided herein are diphtheria toxins having one or more amino acid modifications within the N-terminus and/or the C-terminus of DT T-cell epitope 2 having the amino acid sequence set forth in SEQ ID NO: 184. The N-terminus of DT T-cell epitope 2 comprises amino acid residues 1-9, 2-10, 3-11, 4-12 or any combination therein of the amino acid sequence set forth as SEQ ID NO: 184. The C-terminus of DT T-cell epitope 2 comprises the amino acid residues 22-30, 23-31, 24-32, 25-33 or any combination therein of the amino acid sequence set forth as SEQ ID NO: 184. Further provided herein are modified diphtheria toxins having one or more amino acid modifications in the epitope core and within the N-terminus and/or the C-terminus of SEQ ID NO: 184. In one non-limiting example, the P1 valine residue of the core 9-mer can be replaced with any amino acid residue to modify and/or eliminate the identified T-cell epitope. In one embodiment, a modification provided herein is V97T.

DT T-cell epitope 3 comprises the 9-mer peptide having the amino acid sequence set forth as LGLSLTEPL (SEQ ID NO: 167). Elimination of this T-cell epitope can be achieved by modifying 0, 1, 2, 3, 4, 5, 6, 7, 8, or 9 amino acids of the epitope core and/or modifying 0, 1, 2, 3, 4, 5, 6, 7, 8, 9 or more of the amino acid residues in the N-terminus and/or the C-terminus. In one non-limiting example, provided herein are diphtheria toxins having one or more amino acid modifications within the epitope core of SEQ ID NO: 187, wherein the amino acid modification is by insertion, deletion, or substitution. The core epitope of DT T-cell epitope 3 can comprise amino acid residues 13-21, 12-22, 11-23, 10-24 or any combination therein of the amino acid sequence set forth as SEQ ID NO: 187. Also provided herein are diphtheria toxins having one or more amino acid modifications within the N-terminus and/or the C-terminus of DT T-cell epitope 3 having the amino acid sequence set forth in SEQ ID NO: 187. The N-terminus of DT T-cell epitope 3 comprises amino acid residues 1-9, 2-10, 3-11, 4-12 or any combination therein of the amino acid sequence set forth as SEQ ID NO: 187. The C-terminus of DT T-cell epitope 3 comprises the amino acid residues 22-30, 23-31, 24-32, 25-33 or any combination therein of the amino acid sequence set forth as SEQ ID NO: 187. Further provided herein are modified diphtheria toxins having one or more amino acid modifications in the epitope core and within the N-terminus and/or the C-terminus of SEQ ID NO: 187. In one non-limiting example, the P1 lysine residue of the core 9-mer can be replaced with a polar amino acid residue such that the polar moiety of the residue is surface exposed on the DT molecule and the hydrophobic region is buried in order to modify and/or eliminate the identified T-cell epitope. In yet another non-limiting example, the P6 threonine and/or the P7 glutamic acid positions of the core 9-mer can be substituted with any amino acid to modify and/or eliminate the identified T-cell epitope. In one embodiment, a modification provided herein is T112D.

DT T-cell epitope 4 comprises the 9-mer peptide having the amino acid sequence set forth as MEQVGTEEF (SEQ ID NO: 169). Elimination of this T-cell epitope can be achieved by modifying 0, 1, 2, 3, 4, 5, 6, 7, 8 or 9 amino acids of the epitope core and/or modifying 0, 1, 2, 3, 4, 5, 6, 7, 8, 9 or more of the amino acid residues in the N-terminus and/or the C-terminus. In one non-limiting example, provided herein are diphtheria toxins having one or more amino acid modifications within the epitope core of SEQ ID NO: 190, wherein the amino acid modification is by insertion, deletion, or substitution. The core epitope of DT T-cell epitope 4 can comprise amino acid residues 13-21, 12-22, 11-23, 10-24 or any combination therein of the amino acid sequence set forth as SEQ ID NO: 190. Also provided herein are diphtheria toxins having one or more amino acid modifications within the N-terminus and/or the C-terminus of DT T-cell epitope 4 having the amino acid sequence set forth in SEQ ID NO: 190. The N-terminus of DT T-cell epitope 4 comprises amino acid residues 1-9, 2-10, 3-11, 4-12 or any combination therein of the amino acid sequence set forth as SEQ ID NO: 190. The C-terminus of DT T-cell epitope 4 comprises the amino acid residues 22-30, 23-31, 24-32, 25-33 or any combination therein of the amino acid sequence set forth as SEQ ID NO: 190. Further provided herein are modified diphtheria toxins having one or more amino acid modifications in the epitope core and within the N-terminus and/or the C-terminus of SEQ ID NO: 190. In one non-limiting example, the P6 threonine and/or P7 glutamic acid residues of the core 9-mer can be replaced with any amino acid to modify and/or eliminate the identified T-cell epitope. In one embodiment, a modification provided herein is E117D.

DT T-cell epitope 5 comprises the 9-mer peptide having the amino acid sequence set forth as FIKRFGDGA (SEQ ID NO: 173). Elimination of the T-cell epitope can be achieved by modifying 0, 1, 2, 3, 4, 5, 6, 7, 8 or 9 amino acids of the epitope core and/or modifying 0, 1, 2, 3, 4, 5, 6, 7, 8, 9 or more of the amino acid residues on the N-terminus and/or the C-terminus. In one non-limiting example, provided herein are diphtheria toxins having one or more amino acid modifications within the epitope core of SEQ ID NO: 193, wherein the amino acid modification is by insertion, deletion, or substitution. The core epitope of DT T-cell epitope 5 can comprise amino acid residues 13-21, 12-22, 11-23, 10-24 or any combination therein of the amino acid sequence set forth as SEQ ID NO: 193. Also provided herein are diphtheria toxins having one or more amino acid modifications within the N-terminus and/or the C-terminus of DT T-cell epitope 5 having the amino acid sequence set forth in SEQ ID NO: 193. The N-terminus of DT T-cell epitope 5 comprises amino acid residues 1-9, 2-10, 3-11, 4-12 or any combination therein of the amino acid sequence set forth as SEQ ID NO: 193. The C-terminus of DT T-cell epitope 5 comprises the amino acid residues 22-30, 23-31, 24-32, 25-33 or any combination therein of the amino acid sequence set forth as SEQ ID NO: 193. Further provided herein are modified diphtheria toxins having one or more amino acid modifications in the epitope core and within the N-terminus and/or the C-terminus of SEQ ID NO: 193. In one non-limiting example, the P4 arginine residue, P6 glycine residue, P7 aspartic acid residue, and/or P9 alanine residue of the core 9-mer, or any combination therein, can be replaced to modify and/or eliminate the identified T-cell epitope. In one embodiment, a modification provided herein is R127A.

DT T-cell epitope 6 comprises the 9-mer peptide having the amino acid sequence set forth as VEYINNWEQ (SEQ ID NO: 175). Elimination of this T-cell epitope can be achieved by modifying 0, 1, 2, 3, 4, 5, 6, 7, 8, or 9 amino acids of the epitope core and/or modifying 0, 1, 2, 3, 4, 5, 6, 7, 8, 9 or more of the amino acid residues in the N-terminus and/or the C-terminus. In one non-limiting example, provided herein are diphtheria toxins having one or more amino acid modifications within the epitope core of SEQ ID NO: 196, wherein the amino acid modification is by insertion, deletion, or substitution. The core epitope of DT T-cell epitope 6 can comprise amino acid residues 13-21, 12-22, 11-23, 10-24 or any combination therein of the amino acid sequence set forth as SEQ ID NO: 196. Also provided herein are diphtheria toxins having one or more amino acid modifications within the N-terminus and/or the C-terminus of DT T-cell epitope 6 having the amino acid sequence set forth in SEQ ID NO: 196. The N-terminus of DT T-cell epitope 6 comprises amino acid residues 1-9, 2-10, 3-11, 4-12 or any combination therein of the amino acid sequence set forth as SEQ ID NO: 196. The C-terminus of DT T-cell epitope 6 comprises the amino acid residues 22-30, 23-31, 24-32, 25-33 or any combination therein of the amino acid sequence set forth as SEQ ID NO: 196. Further provided herein are modified diphtheria toxins having one or more amino acid modifications in the epitope core and within the N-terminus and/or the C-terminus of SEQ ID NO: 196. In one non-limiting example, the P1 valine of the core 9-mer can be replaced with polar amino acid residues such that the hydrophilic moiety is surface exposed and the hydrophobic region is buried within the protein to modify and/or eliminate the identified T-cell epitope. In one embodiment, a modification provided herein is V148T.

DT T-cell epitope 7 comprises the 9-mer peptide having the amino acid sequence set forth as LEKTTAALS (SEQ ID NO: 178). Elimination of this T-cell epitope can be achieved by modifying 0, 1, 2, 3, 4, 5, 6, 7, 8, or 9 amino acids of the epitope core and/or modifying 0, 1, 2, 3, 4, 5, 6, 7, 8, 9 or more of the amino acid residues in the N-terminus and/or the C-terminus. In one non-limiting example, provided herein are diphtheria toxins having one or more amino acid modifications within the epitope core of SEQ ID NO: 199, wherein the amino acid modification is by insertion, deletion, or substitution. The core epitope of DT T-cell epitope 7 can comprise amino acid residues 13-21, 12-22, 11-23, 10-24 or any combination therein of the amino acid sequence set forth as SEQ ID NO: 199. Also provided herein are diphtheria toxins having one or more amino acid modifications within the N-terminus and/or the C-terminus of DT T-cell epitope 7 having the amino acid sequence set forth in SEQ ID NO: 199. The N-terminus of DT T-cell epitope 7 comprises amino acid residues 1-9, 2-10, 3-11, 4-12 or any combination therein of the amino acid sequence set forth as SEQ ID NO: 199. The C-terminus of DT T-cell epitope 7 comprises the amino acid residues 22-30, 23-31, 24-32, 25-33 or any combination therein of the amino acid sequence set forth as SEQ ID NO: 199. Further provided herein are modified diphtheria toxins having one or more amino acid modifications in the epitope core and within the N-terminus and/or the C-terminus of SEQ ID NO: 199. In one embodiment, the P1 leucine of the core 9-mer can be replaced with any amino acid to modify and/or eliminate the identified T-cell epitope. In one embodiment, a modification provided herein is S306G.

In one embodiment, a modified diphtheria toxin of contains one or more modifications. Modifications include, but are not limited to, V7S, V7T, V7N, V7D, D8E, S9A, S9T, M15T, V29S, V29T, V29N, V29D, D30E, S31N, V97A, V97D, V97T, L107A, L107N, L107T, T112G, T112D, T112E, E113D, L115T, L115N, L115D, M116A, M116N, M116Q, E117D, T121D, T121G, T121N, T121Q, F124H, F124A, F124K, I125H, R127A, R127T, V148A, V148T, I290T, D291E, S292A, S292T, L298A, L298N, S306G.

In one embodiment, a modified diphtheria toxin contains two modifications. Modifications include, but are not limited to, M15T V97A; M15T V97T; M15T V97D; M15T L107A; M15T L107N; M15T L107T; M15T T112G; M15T T112D; M15T T112E; M15T E113D; M15T L115T; M15T L115N; M15T L115D; M15T M116A; M15T M116N; M15T M116Q; M15T E117D; M15T T121D; M15T T121G; M15T T121N; M15T T121Q; M15T F124H; M15T F124A; M15T F124K; M15T I125H; M15T R127A; M15T R127T; M15T V148A; M15T V148T; M15T L298A; M15T L298N; M15T S306G; V7N V29N; V7N V29T; V7N V29D; V7T V29N; V7T V29T; V7T V29D; V7N V97A; V7N V97T; V7N V97D; V7N L107A; V7N L107N; V7N T112G; V7N T112D; V7N T112E; V7N L115T; V7N L115N; V7N L115D; V7N M116A; V7N M116N; V7N M116Q; V7N T121D; V7N T121G; V7N T121N; V7N T121Q; V7N F124H; V7N I125H; V7N R127A; V7N R127T; V7N V148A; V7N V148T; V7N L298A; and V7N L298N.

In one embodiment, a modified diphtheria toxin contains three modifications. Modifications include, but are not limited to, M15T V97T T112D; M15T V97T E117D; M15T V97T R127A; M15T V97T V148T; M15T V97T S306G; M15T T112D E117D; M15T T112D R127A; M15T T112D V148T; M15T T112D S306G; M15T E117D R127A; M15T E117D V148T; M15T E117D S306G; M15T R127A V148T; M15T R127A S306G; M15T V148T S306G; V7D L107A F124H; V7D L107N F124H; V7N L107A F124H; V7N L107N F124H; V7T L107A F124H; V7N T112D E113D; V7T L107N F124H; V7N V97T L107A; V7N V97T L107N; V7N V97T R127A; V7N V97T R127T; V7N V97T V148T; V7N V97T L298A; and V7N V97T L298N.

In one embodiment, a diphtheria toxin variant contains four modifications. Modifications include, but are not limited to, M15T V97T T112D E117D; M15T V97T T112D R127A; M15T V97T T112D V148T; M15T V97T T112D S306G; M15T V97T E117D R127A; M15T V97T E117D V148T; M15T V97T E117D S306G; M15T V97T R127A V148T; M15T V97T R127A S306G; M15T V97T V148T S306G; M15T T112D E117D R127A; M15T T112D E117D V148T; M15T T112D E117D S306G; M15T T112D R127A V148T; M15T T112D R127A S306G; M15T E117D R127A V148T; M15T E117D R127A S306G; M15T E117D V148T S306G; M15T R127A V148T S306G; V7D V97D L107N F124H; V7N V97D L107N F124H; V7T V97A L107N F124H; V7T V97D L107N F124H; V7T V97T L107N F124H; V7D V97A L107N F124H; V7D V97T L107N F124H; V7N V97A L107N F124H; V7N V97T L107N M116A; V7N V97T L107N M116Q; V7N V97T L107N M116N; V7N V97D L107N M116A; V7N V97D L107N M116Q, V7N V97D L107N M116N, V7N V97T R127A L298A, V7N V97T R127A L298N, V7N V97T R127T L298A, V7N V97T R127T L298N, and V7N V97T L107N F124H.

In one embodiment, a diphtheria toxin variant contains five modifications. Modifications include, but are not limited to, M15T V97T T112D E117D R127A; M15T V97T T112D E117D V148T; M15T V97T T112D E117D S306G; M15T V97T E117D R127A V148T; M15T V97T E117D R127A S306G; M15T V97T R127A V148T S306G; M15T T112D E117D V148T S306G; and M15T E117D R127A V148T S306G.

In one embodiment, a diphtheria toxin variant contains six modifications. Modifications include, but are not limited to, M15T V97T T112D E117D R127A V148T; M15T V97T T112D E117D R127A S306G; M15T V97T E117D R127A V148T S306G; M15T V97T T112D R127A V148T S306G; M15T V97T T112D E117D V148T S306G; M15T V97T T112D E117D R127A S306G; and M15T T112D E117D R127A V148T S306GV7N V97T L107N M116A F124H V148A; V7N V97T L107N M116Q F124H V148A; V7N V97T L107N M116N F124H V148A; V7N V97D L107N M116A F124H V148T; V7N V97D L107N M116Q F124H V148T; V7N V97D L107N M116N F124H V148T; V7N V97T L107N M116A F124H V148T; V7N V97T L107N M116Q F124H V148T; V7N V97T L107N M116N F124H V148T; V7T V97D L107N M116A F124H V148T; V7T V97D L107N M116Q F124H V148T; and V7T V97D L107N M116N F124H V148T.

In one embodiment, a diphtheria toxin variant contains seven modifications. Modifications include, but are not limited to, M15T V97T T112D E117D R127A V148T S306G; V7T V97T L107N M116N F124H V148A L298A;

V7N V97D L107N M116Q F124H V148T L298A; V7N V97D L107N M116N F124H V148T L298A; V7N V97T L107N M116N F124H V148T L298A; V7T V97D L107N M116A F124H V148T L298A; V7T V97D L107N M116N F124H V148T L298A; V7T V97T L107N M116N F124H V148A L298N; V7N V97D L107N M116Q F124H V148T L298N; V7N V97D L107N M116N F124H V148T L298N; V7N V97T L107N M116N F124H V148T L298N; V7T V97D L107N M116A F124H V148T L298N; and V7T V97D L107N M116N F124H V148T L298N.

In addition to the aforementioned examples and embodiments, modified diphtheria toxins with one or more amino acid modifications in one or more T-cell epitopes are contemplated herein. In one non-limiting example, provided herein are diphtheria toxins having at least one modification in at least one T-cell epitope. In another non-limiting example, provided herein is a diphtheria toxin having at least one amino acid modification in 1, 2, 3, 4, 5, 6, or 7 of the T-cell epitopes described above. Additional non-limiting examples include diphtheria toxins having more than one amino acid modification in more than one T-cell epitope. Any combination of the amino acid modifications in any number of the DT T-cell epitopes described above are contemplated herein.

Provided herein are modified DT molecules containing a mutation in T cell epitope 1 either alone or in combination with a mutation in one or more of T cell epitopes 2 through 7. In one embodiment, a DT molecule is modified in T cell epitopes 1 and 2. In one embodiment, a DT molecule is modified in T cell epitopes 1 and 3. In one embodiment, a DT molecule is modified in T cell epitopes 1 and 4. In one embodiment, a DT molecule is modified in T cell epitopes 1 and 5. In one embodiment, a DT molecule is modified in T cell epitopes 1 and 6. In one embodiment, a DT molecule is modified in T cell epitopes 1 and 7.

Also provided herein is a modified DT molecule containing a mutation in T cell epitope 1. In one embodiment, a DT molecule is modified with a substitution of V by N, A or T at amino acid residue 7.

Also provided herein is a modified DT molecule containing a mutation in T cell epitope 2 either alone or in combination with a mutation in one of T cell epitopes 1 and/or 3-7. In one embodiment, a DT molecule is modified with a substitution of V by T at amino acid residue 97.

Also provided herein is a modified DT molecule containing a mutation in T cell epitope 3 either alone or in combination with a mutation in one of T cell epitopes 1, 2 and/or 4-7

Also provided herein is a modified DT molecule containing a mutation in T cell epitope 4 either alone or in combination with a mutation in one of T cell epitopes 1-3 and/or 5-7.

Also provided herein is a modified DT molecule containing a mutation in T cell epitope 5, either alone or in combination with a mutation in one of T cell epitopes 1-4, 6 and/or 7. In one embodiment, T cell epitope variants are constructed as double mutants with V7N and triple mutants with V7N and N97T. Constructs may also be made such that variants of T cell epitope 5 are constructed to target the p2 TCR contact residue I125 and the p4 MHC anchor residue R127. Non-limiting examples of such mutants include, but are not limited to, V7N I125H, V7N R127A, V7N R127T, V7N V97T R127A, and V7N V97T R127T.

Also provided herein is a modified DT molecule containing a mutation in T cell epitope 6 either alone or in combination with a mutation in one of T cell epitopes 1-5 and/or 7. In one embodiment, a DT molecule is modified with a substitution of V by T at amino acid residue 148.

Also provided herein is a modified DT molecule containing a mutation in T cell epitope 7 either alone or in combination with a mutation in one of T cell epitopes 1-6. In one embodiment, a DT molecule is modified with a substitution of L by A or N at amino acid residue 298.

In another aspect, also provided herein is a modified DT molecule containing a mutation in T cell epitopes 1, 2 and 7. In yet another aspect, also provided herein is a modified DT molecule containing a mutation in T cell epitopes 1, 2 and 6.

Constructs of DT molecules modified two T cell epitopes include, but are not limited to, V7N V97A, V7N V97T, V7N L97D, V7N L107A, V7N L107N, V7N M116A, V7N M116N, V7N M116Q, V7N V148A, V7N V148T, V7N L298A, and V7N L298N. Constructs also include modified DT molecules modified by making three amino acid substitutions. For example, constructs of DT molecules modified at three T cell epitopes include, but are not limited to, V7N V97T L298A and V7N V97T L298N.

DT T-Cell Epitopes and Allotype Frequency

Individual epitopes found within antigens can be preferentially presented by specific MHC class II allotypes, and similarly other specific epitopes within the same antigen may not be presented on MHC class II molecules at all. Such associations of particular epitopes with specific MCH class II molecules have been shown to depend upon the MHC class II allotype of the individual. The association of a specific epitope with a specific allotype can also be considered when modifying DT for the removal of T-cell epitopes. Such considerations can allow for the highly specific modification of a DT molecule for specific allotypes (e.g. for specific populations of subjects having certain MHC class II allotypes). The MHC class II allotype of a subject or subjects can be easily determined by genotyping methods known in the art, and the association of DT T-cell epitopes with the given allotype thus easily identified, for consideration in modification of a toxin tailored to that allotype. Identification of associations between DT T-cell epitopes and MHC class II allotypes are shown in Example 9 and Table 5. Contemplated herein are modified toxins that have T-cell epitope modifications tailored to the MHC class II associations identified for the given epitopes of the toxin.

Based on the teachings of the present specification, one can apply these methods to other toxins described herein. For example amino acid sequences of toxins which have been analyzed with respect to MHC associations and T-cell epitopes can be readily used. In addition, toxins which have not been analyzed with respect to MHC associations can also be analyzed and tested using the methods described throughout the specification and in the examples below.

III. B-Cell Epitope Screen

In addition to the identification and modification of T-cell epitopes as disclosed herein, the identification and modification of B-cell epitopes can further reduce the immunogenicity of a toxin. Serological methods, in silico methods, or a combination of both methods can be used to identify B-cell epitopes within a toxin or modified toxin. Serological methods employ the ability of a subject to generate antibodies to immunogenic molecules, including proteins, peptides, and polypeptides. When a toxin or modified toxin is one that has been previously administered to a population, such as for vaccination, the antibody response generated in the subjects can be used to screen toxins or modified toxins for B-cell epitopes. In one non-limiting example, a toxin (e.g., diphtheria toxin) that has had its T-cell epitopes modified as disclosed herein can be further screened to identify B-cell epitopes. A peptide library based upon the sequence of the modified toxin can be synthesized, and sera from toxin-vaccinated donors that contain antibodies against the toxin can be tested for the ability to bind to the peptides of the peptide library. Various techniques and assays including, but not limited to, ELISA, RIA, and Western blotting are well known in the art and can be used to identify one or more peptides which bind to antibodies from the sera of toxin-vaccinated donors. Those one or more peptides which bind antibodies in the donor sera represent B-cell epitopes within the toxin sequence. Following the identification of modified toxin B-cell epitopes, amino acid residues that correspond to the B-cell epitopes can be modified, and the modified toxin re-screened against donor sera. This process can be performed multiple times to further reduce the immunogenicity of the modified toxin. As noted for the identification of T-cell epitopes herein, in silico methods which utilize known B-cell epitope databases and predictive protein modeling programs can be employed to identify B-cell epitopes within a toxin or modified toxin. Once such epitopes are identified and modified via the in silico methods, the modified toxin can be screened against vaccinated donor sera as described herein. The in silico B-cell epitope screening methods can be used alone or in combination with the peptide library B-cell epitope screen for identification and modification of B-cell epitopes within the toxin. Optionally, the modified toxin can be screened prior to, and or subsequently to, B-cell epitope screening. Also contemplated herein is screening a B-cell epitope modified toxin for the presence of any T-cell epitopes that may be been generated during B-cell epitope modification.

Application of the invention described herein includes a method of selecting a modified toxin wherein said modified toxin has lost at least one B-cell epitope comprising obtaining a serum sample from at least one subject immunized with a toxin, wherein said serum contains antibodies against said toxin, contacting said serum with one or more modified toxins wherein binding of said antibodies to said modified toxin forms a complex, detecting the presence or absence of said complex, wherein if a complex is detected, the modified toxin has not lost at least one B-cell epitope and if a reduced level of complex is detected, the modified toxin has lost at least one B-cell epitope, and selecting a modified toxin that has lost at least one B-cell epitope. In one non-limiting embodiment, a reduced level of complex can be, for example, about 1.5-fold less, about 2-fold less, about 5-fold less, about 10-fold less, about 20-fold less, about 50-fold less, about 100-fold less, about 200-fold less, or about 500-fold less than that observed with an unmodified toxin.

IV. Vascular Leak Syndrome

Cell damage, particularly endothelial cell damage, whether produced by toxins, such as from snake bites or molecules causing septic shock, or therapeutic agents, such as immunotoxins or interleukins, remains a problem for patients.

VLS is often observed during bacterial sepsis and may involve IL-2 and a variety of other cytokines. The mechanisms underlying VLS are unclear and are likely to involve a cascade of events which are initiated in endothelial cells (ECs) and involve inflammatory cascades and cytokines. VLS has a complex etiology involving damage to vascular endothelial cells (ECs) and extravasation of fluids and proteins resulting in interstitial edema, weight gain and, in its most severe form, kidney damage, aphasia, and pulmonary edema. Vascular leak syndrome (VLS) has been a major problem with all immunotoxins thus far tested in humans, as well as cytokines such as interleukin 2 (IL-2), TNF and adenovirus vectors.

Antibody-conjugated peptides from ricin toxin A chain containing a modified sequence at residues L74, D75, V76, exhibited reduced. Thus, it is contemplated that one or more amino acid deletion(s) or mutation(s) of the (x)D/E(y) sequence(s), and/or one or more flanking residues of a toxin, such as for example, diphtheria toxin, may reduce or prevent the ability of toxin molecules comprising these sequences to induce EC damage. It is expected that one or more polypeptides comprising at least one mutated motif and/or one ore more flanking residues can be created that reduce or eliminate the EC damaging activity of such agents.

Described herein below are compositions with reduced VLS promoting abilities based upon mutations in the (x)D/E(y) or (x)D/E(y)T sequences within polypeptides, which remove or alter such sequences, respectively, and their methods of use. Thus, it will be understood that all methods described herein for producing polypeptides with reduced VLS promoting ability will be applied to produce polypeptides with reduced EC damaging activity. All such methods, and compositions identified or produced by such methods as well as equivalents thereof, are encompassed by the present invention.

In certain aspects, the application provides the use of a modified toxin composition that has at least one amino acid of a sequence comprising (x)D/E(y) and/or (x)D/E(y)T removed or altered, relative to the sequence of an unmodified toxin composition, for the manufacture of a medicament for the treatment of a disease, including but not limited to malignant diseases such as, for example cutaneous T-cell lymphoma, relapsed/refractory T-cell non-Hodgkin lymphoma, relapsed/refractory B-cell non-Hodgkin lymphoma, panniculitic T-cell lymphoma, extranodal natural killer/T cell lymphoma, nasal type, chronic lymphocytic leukemia, and human T-cell lymphotrophic virus 1-associated acute T cell leukemia/lymphoma; non-malignant diseases such as, for example, graft versus host disease and psoriasis and damage to endothelial cells (i.e., VLS) during the progression of such diseases.

Reduction or elimination of Vascular Leak Syndrome (VLS) as a side effect would represent a significant advancement as it would improve the "risk benefit ratio" of protein therapeutics, and in particular, the immunotoxin and fusion toxin subclasses of protein therapeutics. The ability to develop fusion proteins, single chain molecules comprised of a cytotoxin and unique targeting domain (cell binding domains in the case of immunotoxins) could facilitate the development of the therapeutic agents for autoimmune diseases, such as rheumatoid arthritis and psoriasis transplant rejection and other non-malignant medical indications. DAB389IL-2 (ONTAK®) is currently the only FDA approved protein fusion toxin and employs a DT toxophore and the cytokine IL-2 to target IL-2 receptor bearing cells and is approved for the treatment of cutaneous T-cell lymphoma (CTCL) ONTAK® is variously referred to as denileukin diftitox, DAB389-IL-2, or Onzar. Its structure is comprised of, in order, a methionine residue, residues 1-386 of native DT, residues 484-485 of native DT, and residues 2-133 of IL-2 (SEQ ID NO: 148). Hence, full length ONTAK® contains 521 amino acids. It should be noted that, as a result of the methionine residue added at the N terminus of ONTAK®, numbering in the sequence of diphtheria is out of register with that of ONTAK® by one.

A number of other toxophores, most notably ricin toxin and *pseudomonas* exotoxin A, have been employed in developing both immunotoxins, fusion toxins and chemical conjugates; however, these molecules have not successfully completed clinical trials and all exhibit VLS as a pronounced side effect. Thus, the modifications described herein for diphtheria toxin can be extrapolated to other toxins such as, for example, ricin and *pseudomonas* exotoxin A.

In certain embodiments, toxins or compounds modified based on one or more of the (x)D(y) and/or (x)D(y)T motifs or its flanking sequences can be used to inhibit VLS in vivo. Thus, it is contemplated that such mutations that affects the (x)D(y) sequence or flanking sequence can alter the ability of a polypeptide to induce VLS or other abilities associated with these sequences. In one non-limiting example, diphtheria toxin is modified to inhibit VLS in vivo.

In order to produce toxins or compounds that have a reduced ability to induce VLS, it is contemplated that one or more (up to, and including all) remaining (x)D(y) and/or (x)D(y)T sequences have a reduced exposure to the surface of the polypeptide. For example, it is contemplated that (x)D(y) and/or (x)D(y)T sequences that are at least partly located in the non-exposed portions of a polypeptide, or otherwise masked from full or partial exposure to the surface of the molecule, would interact less with cells, receptors or other molecules to promote or induce VLS. Thus, the complete elimination of (x)D(y) and/or (x)D(y)T sequences from the primary structure of the polypeptide may not be necessary to produce toxins or molecules with a reduced ability to induce or promote VLS. However, removal of all (x)D(y) and/or (x)D(y)T sequences is contemplated to produce a composition that has the least ability to induce or promote VLS.

To determine whether a mutation would likely produce a polypeptide with a less exposed (x)D(y) and/or (x)D(y)T motif, the putative location of the moved or added (x)D(y) and/or (x)D(y)T sequence can be determined by comparison of the mutated sequence to that of the unmutated polypeptide's secondary and tertiary structure, as determined by such methods known to those of ordinary skill in the art including, but not limited to, X-ray crystallography, NMR or computer modeling. Computer models of various polypeptide structures are also available in the literature or computer databases. In a non-limiting example, the Entrez database website (ncbi.nlm.nih.gov/Entrez/) can be used to identify target sequences and regions for mutagenesis. The Entrez database is cross-linked to a database of 3-D structures for the identified amino acid sequence, if known. Such molecular models can be used to identify (x)D(y), (x)D(y)T and/or flanking sequences in polypeptides that are more exposed to contact with external molecules, than similar sequences embedded in the interior of the polypeptide. (x)D(y), (x)D(y)T and/or flanking sequences that are more exposed to contact with external molecules are more likely to contribute to promoting or reducing VLS and other toxic effects associated with these sequences and, thus, should be primary targets for mutagenesis. The mutated or wild-type polypeptide's structure could be determined by X-ray crystallography or NMR directly before use in in vitro or in vivo assays, as would be known to one of ordinary skill in the art.

Once an amino acid sequence comprising a (x)D(y) and/or (x)D(y)T sequence is altered in a polypeptide, changes in its ability to induce or promote at least one toxic effect can be assayed using any of the techniques described herein or as known to one of ordinary skill in the art.

As used herein, "alter," "altered," "altering," and "alteration" of an amino acid sequence comprising a (x)D(y) sequence or a (x)D(y)T sequence can include chemical modification of an amino acid sequence comprising a (x)D(y) and/or a (x)D(y)T sequence in a polypeptide as known to those of ordinary skill in the art, as well as any mutation of such an amino acid sequence including, but not limited to, insertions, deletions, truncations or substitutions. Such changes can alter or modify (reduce) at least one toxic effect (i.e., the ability to promote VLS, EC damage, etc.) of one or more amino acid sequence(s) comprising a (x)D(y) and/or (x)D(y)T sequences. As used herein an amino acid sequence comprising a (x)D(y) sequence or a (x)D(y)T sequence can contain at least one flanking sequence C- and/or N-terminal to a (x)D(y) and/or a (x)D(y)T tri- or quatra-peptide sequence. Such an "alteration" can be made in synthesized polypeptides or in nucleic acid sequences that are expressed to produce mutated polypeptides.

In one aspect, the alteration of an amino acid sequence containing a (x)D(y) and/or a (x)D(y)T sequence is by removal of the amino acid sequence. As used herein, "remove", "removed", "removing" or "removal" of an amino acid sequence containing a (x)D(y) and/or a (x)D(y)T sequence refers to a mutation in the primary amino acid sequence that eliminates the presence of the (x)D(y) and/or a (x)D(y)T tri- or quatra-peptide sequence, and/or at least one native flanking sequence. The terms "removed" or "lacks" are used interchangeably.

One aspect of the present application relates to genetically modified polypeptides of diphtheria toxin (DT) having reduced binding to human vascular endothelial cells (HUVECs). These modified polypeptides are hereinafter referred to as modified DTs, modified DT polypeptides or DT variants. The present application provides for modified DT having one or more changes within the (x)D(y) motifs of the DT polypeptide, i.e., at residues 6-8 (VDS), residues 28-30 (VDS), and residues 289-291 (IDS) of the native DT sequence (SEQ ID NO:1), or at residues 7-9 (VDS), residues 29-31 (VDS), and residues 290-292 (IDS) of SEQ ID NO: 2, 148 or 200. Since the (x)D(y) motifs are referred to as "VLS motifs," the modified DT polypeptides with one or more modified (x)D(y) motifs can be referred to as "VLS-modified DT polypeptides."

One aspect of the present application relates to genetically modified polypeptides of toxins (e.g. diphtheria toxin (DT)) having reduced binding to human vascular endothelial cells (HUVECs). These modified toxins are hereinafter referred to as modified toxins. The present application provides for modified toxins having one or more changes within the (x)D/E(y) motifs of the toxin polypeptide. For example, (x)D/E(y) motifs found within DT occur at residues 6-8 (VDS), residues 28-30 (VDS), and residues 289-291 (IDS) of the native DT sequence (SEQ ID NO 1), or at residues 7-9 (VDS), residues 29-31 (VDS), and residues 290-292 (IDS) of SEQ ID NO 2, 148 or 200. Since the (x)D/E(y) motifs are referred to as "VLS motifs," the modified toxin polypeptides with one or more modified (x)D/E(y) motifs are sometimes referred to as "VLS-modified toxin polypeptides."

With the identification of the (x)D/E(y) and the (x)D/E(y)T motifs as inducing VLS, inducing apoptosis, and other effects, it is possible that the creation of a new family of molecules of VLS inhibitors will allow these molecules to exert maximal beneficial effects. For example, a reduced toxicity of toxin therapeutic agents using the compositions and methods disclosed herein may allow larger patient population to be treated or more advanced disease to be treated (e.g., cancer). In certain embodiments, modified proteins or fusion proteins based on the (x)D/E(y) and/or (x)D/E(y)T motif or its flanking sequences may be used to inhibit VLS or other activities in vivo.

To produce peptides, polypeptides or proteins that lack the (x)D/E(y) and/or (x)D/E(y)T sequence, one could delete or mutate the conserved aspartic acid (D) or the conserved glutamic acid (E), substitute another amino acid for the aspartic acid or the glutamic acid, or insert one or more amino acids at or adjacent to its position. Modifications contemplated herein include a substitution of the (D) or (E) residue in the sequence with an amino acid residue selected from among alanine (A), Glutamic acid (E), Serine (S), isoleucine (I), valine (V), leucine (L), phenylalanine (F), cysteine (C), methionine (M), glycine (G), threonine (T), tryptophan (W), tyrosine (Y), proline (P), histidine (H), glutamine (Q), asparagine (N), lysine (K), arginine (R) and a modified or unusual amino acid from Table 1, as a consequence of a deletion or mutation event.

Alternatively, to produce peptides, polypeptides or proteins that lack the (x)D(y) and/or (x)D(y)T sequence, one could delete or mutate the conserved aspartic acid (D), substitute another amino acid for the aspartic acid, or insert one or more amino acids at or adjacent to its position. Modifications contemplated herein include a substitution of the (D) residue in the sequence by an amino acid residue selected from among isoleucine (I), valine (V), leucine (L), phenylalanine (F), cysteine (C), methionine (M), alanine (A), glycine (G), threonine (T), tryptophan (W), tyrosine (Y), proline (P), histidine (H), glutamine (Q), asparagine (N), lysine (K), arginine (R) and a modified or unusual amino acid from Table 1, as a consequence of a deletion or mutation event.

TABLE 1

| Abbreviation | Amino acid | Abbreviation | Amino acid |
|---|---|---|---|
| Aad | 2-Aminoadipic acid | EtAsn | N-Ethylasparagine |
| BAad | 3-Aminoadipic acid | Hyl | Hydroxylysine |
| BAla | β-alanine, β-Amino-propionic acid | Ahyl | Allo-Hydroxylysine |
| Abu | 2-Aminobutyric acid | 3Hyp | 3-Hydroxyproline |
| 4Abu | 4--Aminobutyric acid, piperidinic acid | 4Hyp | 4-Hydroxyproline |
| Acp | 6-Aminocaproic acid | Ide | Isodesmosine |
| Ahe | 2-Aminoheptanoic acid | Aile | Allo-Isoleucine |
| Aib | 2-Aminoisobutyric acid | MeGly | N-Methylglycine, sarcosine |
| BAib | 3-Aminoisobutyric acid | MeIle | N-Methylisoleucine |
| Apm | 2-Aminopimelic acid | MeLys | 6-N-Methyllysine |
| Dbu | 2,4-Diaminobutyric acid | MeVal | N-Methylvaline |
| Des | Desmosine | Nva | Norvaline |
| Dpm | 2,2'-Diaminopimelic acid | Nle | Norleucine |
| Dpr | 2,3-Diaminopropionic acid | Orn | Ornithine |
| EtGly | N-Ethylglycine | | |

In one embodiment, the (x) residue could be deleted, substituted, or moved by the insertion of one or more amino acids, to remove the (x)D/E(y) and/or (x)D/E(y)T sequence. Modifications contemplated herein include a substitution of the (x) residue in the sequence an amino acid residue selected from among phenylalanine (F), cysteine (C), methionine (M), threonine (T), tryptophan (W), tyrosine (Y), proline (P), histidine (H), glutamic acid (E), glutamine (Q), aspartic acid (D), asparagine (N), lysine (K), arginine (R), glycine (G), serine (S), alanine (A), leucine (L), and a modified or unusual amino acid from Table 1 as a consequence of the deletion or mutation event.

Alternatively, the (x) residue could be deleted, substituted, or moved by the insertion of one or more amino acids, to remove the (x)D(y) and/or (x)D(y)T sequence. Modifications contemplated herein include a substitution of the (x) residue in the sequence by an amino acid residue selected from among phenylalanine (F), cysteine (C), methionine (M), threonine (T), tryptophan (W), tyrosine (Y), proline (P), histidine (H), glutamic acid (E), glutamine (Q), aspartic acid (D), asparagine (N), lysine (K), arginine (R) and a modified or unusual amino acid from Table 1 as a consequence of the deletion or mutation event. For example, a V or I amino acid residue as described is replaced with any of such amino acid residues.

In one embodiment, the (y) residue could be deleted, substituted, or moved by the insertion of one or more amino acids, to remove the (x)D/E(y) and/or (x)D/E(y)T sequence. An amino acid that may replace the (y) residue in the sequence as a consequence of the deletion or mutation event is, for example, isoleucine (I); phenylalanine (F); cysteine/cystine (C); methionine (M); alanine (A); glycine (G); threonine (T); tryptophan (W); tyrosine (Y); proline (P); histidine (H); glutamic acid (E); glutamine (Q); aspartic acid (D); asparagine (N); lysine (K); and arginine (R), leucine (L), valine (V), serine (S), and including, but not limited to, those shown at Table 1.

Alternatively, the (y) residue could be deleted, substituted, or moved by the insertion of one or more amino acids, to remove the (x)D(y) and/or (x)D(y)T sequence. An amino acid that may replace the (y) residue in the sequence as a consequence of the deletion or mutation event is, for example, isoleucine (I); phenylalanine (F); cysteine/cystine (C); methionine (M); alanine (A); glycine (G); threonine (T); tryptophan (W); tyrosine (Y); proline (P); histidine (H); glutamic acid (E); glutamine (Q); aspartic acid (D); asparagine (N); lysine (K); and arginine (R), and including, but not limited to, those shown at Table 1.

Other residues that are positioned in the physical region, three-dimensional space, or vicinity of the HUVEC binding site and/or the (x)D/E(y) motif may be mutated or altered to abrogate, reduce, or eliminate VLS. The amino acids targeted for mutation in the flanking regions include amino acids on or near the surface of a native toxin protein. The alteration may remove or substitute a charged residue in the region of a (x)D/E(y) motif, which may negate or reverse the charge in a particular area on the surface of the protein. The alteration may also change size and/or hydrophilic nature of an amino acid in the physical region, space or vicinity of the (x)D/E(y) sequence or active site of a protein. For example, LDV constitutes the minimal active site in the CS1 domain of fibronectin responsible for its binding to the α4β1 integrin receptor. However, fibronectin (FN) does not damage HUVECs. Instead, FN protects HUVECs from RTA-mediated damage. Unlike RTA, FN has a C-terminal LDV-flanking proline instead of a threonine. In disintegrins, residues flanking RGD play a role in ligand binding. The difference between the ability of an LDV- or homologue-containing molecule to promote vascular integrity (e.g., FN) or disrupt it (e.g., DT) may depend on the orientation, or availability for interaction (i.e., binding), of the LDV motif and hence, on flanking sequences. Therefore, changes in one or more flanking residues of the (x)D/E(y) sequence may enhance or reduce the ability of a molecule to promote VLS. Further, changes that expose the (x)D/E(y) sequence to the external surface of the protein so as to interact with other proteins, such as receptors, would enhance VLS promoting activity, while conformations that are less exposed may reduce VLS promoting activity.

At least one mutation, chemical modification, movement or other alteration in the N- or C-terminal flanking sequences of the (x)D/E(y) and/or (x)D/E(y)T sequence may also produce proteins, polypeptides or peptides that have a reduced ability to promote VLS. Preferably, such mutations or alterations would occur in one or more residues which will not affect the active site. In other embodiments, the mutations or alterations would occur in one or more residues of from about 1, about 2, about 3, about 4, about 5, about 6 or more N-terminal and/or C-terminal to the (x)D/E(y) tripeptide sequence. In other aspects, one or more residues that are not adjacent to the (x)D/E(y) tripeptide may contribute to the function of the (x)D/E(y) motif. Such residues may be identified by their proximity to the tripeptide sequence in a 3-dimensional model, as described herein and as would be known to one of ordinary skill in the art, and are contemplated for alteration as part of a flanking sequence. Such alterations may include any of those described above for altering the (x)D/E(y) and (x)D/E(y)T sequences, as long as one or more "wild type" flanking residues are altered, removed, moved, chemically modified, etc. Alterations may be made within about 5 Å, about 10 Å, about 15 Å, or about 20 Å of the (x)D/E(y) and (x)D/E(y)T sequences Such amino acid modifications can be assayed for the ability to effectively deliver the catalytic domain of DT to a targeted cell within the context of a fusion protein, and not reconstitute an intact VLS motif. Provided herein are modified diphtheria toxins that have a reduced ability to induce VLS; any remaining (x)D/E(y) and/or (x)D/E(y)T sequences, if possible, are to have a reduced exposure to the surface of the protein, polypeptide or peptide.

In one non-limiting example, it is contemplated that (x)D/E(y) and/or (x)D/E(y)T sequences that are at least partly located in the non-exposed portions of a diphtheria toxin, or otherwise masked from full or partial exposure to the surface of the molecule, would interact less with cells, receptors or other molecules to promote or induce VLS. Thus, it is contemplated that the complete elimination of (x)D/E(y) and/or (x)D/E(y)T sequences from the primary structure of the diphtheria toxin is not necessary to produce toxins or molecules with a reduced ability to induce or promote VLS. However, in one embodiment, all (x)D/E(y) and/or (x)D/E(y)T sequences are removed to generate a composition that has the least ability to induce or promote VLS.

To determine whether a mutation would likely produce a modified toxin with a less exposed (x)D/E(y) and/or (x)D/E(y)T motif, the putative location of the moved or added (x)D/E(y) and/or (x)D/E(y)T sequence could be determined by comparison of the mutated sequence to that of the unmutated toxin's secondary and tertiary structure, as determined by such methods known to those of ordinary skill in the art including, but not limited to, X-ray crystallography, NMR or computer modeling. Computer models of various polypeptide and peptide structures are also available in the literature or computer databases. In a non-limiting example, the Entrez database world wide web site (ncbi.nlm.nih.gov/Entrez/) can be used to identify target sequences and regions for mutagenesis. The Entrez database is crosslinked to a database of 3-D structures for the identified amino acid sequence, if known. Such molecular models can be used to identify (x)D/E(y), (x)D/E(y)T and/or flanking sequences in diphtheria toxin that are more exposed to contact with external molecules, (e.g. receptors) than similar sequences embedded in the interior of the polypeptide or polypeptide. It is contemplated that (x)D/E(y), (x)D/E(y)T and/or flanking sequences that are more exposed to contact with external molecules are more likely to contribute to promoting or reducing VLS and other toxic effects associated with these sequences, and, thus, should be primary targets for mutagenesis. In certain embodiments, when adding at least one (x)D/E(y), (x)D/E(y)T and/or flanking sequence is desirable, regions of the protein that are more exposed to contact with external molecules are preferred as sites to add such a sequence. The mutated or wild-type toxin's structure could be determined by X-ray crystallography or NMR directly before use in in vitro or in vivo assays, as would be known to one of ordinary skill in the art.

Once an amino acid sequence comprising a (x)D/E(y) and/or (x)D/E(y)T sequence is altered in a toxin, changes in its ability to promote at least one toxic effect can be assayed by any of the techniques described herein or as would be known to one of ordinary skill in the art. Methods of altering (changing) amino acid sequences are described in more detail below and are known in the art.

Modifications (changes) are those amino acid substitutions, insertions or deletions which permit the alteration of a native sequence or a previously modified sequence within these regions but do not impair the cytotoxicity of a toxin or toxophore. These modifications would not include those that regenerate the VDS/IDS sequences responsible for mediating the interaction with endothelial cells. Such non-native recombinant sequences therefore comprise a novel series of mutants that maintain the native function of the unique domains of toxin while significantly decreasing their ability to interact with vascular endothelial cells.

In one embodiment, the DT variants of the present invention contain at least one modification within one of the (x)D/E(y) motifs of the DT molecule, i.e., within residues 6-8 (VDS), residues 28-30 (VDS), and residues 289-291 (IDS) of SEQ ID NO:1 to eliminate motifs that are associated with VLS and thereby reduce the clinical adverse effects commonly associated with this syndrome. The modified DTs of the present application, however, are as effective and efficient as DT387 in their ability to facilitate the delivery of its catalytic domain to the cytosol of targeted eukaryotic cells when incorporated into protein fusion toxins. DT387 (SEQ ID NO 2) is a truncated DT protein comprising amino acid residues 1-386 of the native DT protein including the catalytic domain and the translocation domain and an addition of an N-terminal methionine. $DT_{389}$ (SEQ ID NO: 200) is a truncated DT protein including in order, a methionine residue, residues 1-386 of native DT and residues 484-485 of native DT. $DT_{389}IL2$ (SEQ ID NO: 148) is a truncated DT protein including in order, a methionine residue, residues 1-386 of native DT, residues 484-485 of native DT, and IL-2. In one embodiment, the DT variants of the present invention contain at least one modification within one of the (x)D/E(y) motifs of the DT molecule, i.e., within residues 7-9 (VDS), residues 29-31 (VDS), and residues 290-292 (IDS) of SEQ ID NO:2, 148 or 200 to eliminate motifs that are associated with VLS and thereby reduce the clinical adverse effects commonly associated with this syndrome.

By way of example only, unmodified diphtheria toxins can have, for example, an amino acid sequence of SEQ ID NO: 2, 148 or 200. Additionally, unmodified diphtheria toxins can refer to ONTAK® and/or diphtheria toxins linked to other proteins or molecules. ONTAK® (DAB389IL2), for example, can have an amino acid sequence of SEQ ID NO. 148.

In one embodiment, a modified diphtheria toxin having (exhibiting) cytotoxicity comparable to an unmodified diphtheria toxin refers to a modified diphtheria toxin having (exhibiting) cytotoxicity substantially similar to an unmodified diphtheria toxin.

In another embodiment, a modified diphtheria toxin having (exhibiting) cytotoxicity comparable to an unmodified diphtheria toxin refers to a modified diphtheria toxin having cytotoxicity of at least about 5%, at least about 10%, at least about 20%, at least about 30%, at least about 40%, at least about 50%, at least about 55%, at least about 60%, at least about 65%, at least about 70%, at least about 75%, at least about 80%, at least about 85%, at least about 90%, or at least about 95% more cytotoxicity compared to an unmodified diphtheria toxin. In another embodiment, Cytotoxicity in a modified diphtheria toxin (or fusions thereof) may be by about 1.5 fold, about 2 fold, about 3 fold, about 4 fold, about 5 fold, about 6 fold, about 7 fold, about 8 fold, about 9 fold, about 10 fold, about 15 fold, about 20 fold, about 30 fold, about 40 fold, about 50 fold or more (or any integer there between) compared to an unmodified diphtheria toxin (or fusion thereof). Methods for assaying reductions or changes in the aforementioned side-effects are known in the art and as described herein.

In another embodiment, a modified diphtheria toxin having (exhibiting) cytotoxicity comparable to an unmodified diphtheria toxin refers to a modified diphtheria toxin having (exhibiting) cytotoxicity of at least about 5%, at least about 10%, at least about 20%, at least about 30%, at least about 40%, at least about 50%, at least about 55%, at least about 60%, at least about 65%, at least about 70%, at least about 75%, at least about 80%, at least about 85%, at least about 90%, or at least about 95% less cytotoxicity compared to an unmodified diphtheria toxin. Cytotoxicity in a modified diphtheria toxin (or fusions thereof) may be by about 1.5 fold, about 2 fold, about 3 fold, about 4 fold, about 5 fold, about 6 fold, about 7 fold, about 8 fold, about 9 fold, about 10 fold, about 15 fold, about 20 fold, about 30 fold, about 40 fold, about 50 fold or less (or any integer there between) compared to an unmodified diphtheria toxin (or fusion thereof). Methods for assaying reductions or changes in the aforementioned side-effects are known in the art and as described herein.

Purified DAB389IL-2 produced in *E. coli* generally yields an IC50 of between $5\times10^{-11}$ M and $1\times10^{-12}$ M. Thus, in another embodiment, a modified diphtheria toxin having cytotoxicity comparable to an unmodified diphtheria toxin refers to a modified diphtheria toxin having an IC50 of between about $5\times10^{-11}$ M to about $1\times10^{-12}$ M, of about $1\times10^{-10}$ M to about $5\times10^{-11}$ M, of about $1\times10^{-9}$ M to about $1\times10^{-10}$ M, of about $1\times10^{-8}$ M to about $1\times10^{-9}$ M, or of about $1\times10^{-7}$ M to about $1\times10^{-8}$ M. The modified toxins can also have cytotoxicity greater than an unmodified diphtheria toxin or ONTAK, and cytotoxicity of a modified diphtheria toxin compared to an unmodified diphtheria toxin or ONTAK® can be tested in a cytotoxicity assay such as that described below in the Examples.

In additional embodiments, the modified diphtheria toxins (or fusions thereof) can have comparable efficacy of treatment to an unmodified diphtheria toxin (or fusions thereof) or ONTAK®. In addition to treatment of a disease or condition, efficacy of treatment also may include reduction of side-effects due to administration of the therapeutic (e.g. ONTAK® or the modified diphtheria toxins or fusions thereof) as well as side-effects associated with the disease to be treated. Side effects include, for example, adverse drug events (ADEs) and toxicities such as one or more of the following: capillary leak syndrome, dehydration, hypotension, fever, hypoalbuminemia, skin disorder, chest pain, vascular fragility, fatigue, hypersensitivity, myocardial ischemia, urinary tract infection, decreased blood pressure, joint stiffness, myalgia, carpel tunnel syndrome, loss of consciousness, respiratory distress, dermatitis exfoliative, erythema, and generalized rash, hypersensitivity. Reduction in one or more adverse drug events (ADEs)/toxicity in a modified diphtheria toxin (or fusions thereof) compared to an unmodified diphtheria toxin (or fusion thereof) may be by about 1.5 fold, about 2 fold, about 3 fold, about 4 fold, about 5 fold, about 6 fold, about 7 fold, about 8 fold, about 9 fold, about 10 fold, about 15 fold, about 20 fold, about 30 fold, about 40 fold, or about 50 fold or more (or any integer there between). Methods for assaying reductions or changes in the aforementioned side-effects are known in the art and as described herein.

In addition to reduced side-effects and/or toxicity, the diphtheria toxins with reduced cytotoxicity can result in an increased specificity of treatment. The number of ONTAK® molecules that are internalized in a cell may affect the potential for death of the cell. In one embodiment, a reduction in the cytotoxicity of a diphtheria toxin as described herein may result in a need for more diphtheria toxins to kill a targeted cell. In another embodiment, a reduction in the cytotoxicity of a diphtheria toxin as described herein may not result in a need for more diphtheria toxins to kill a targeted cell; in such an embodiment, a modified diphtheria toxin exhibiting reduced cytotoxicity may still be effective in killing target cells and induce fewer side effects.

Diphtheria toxin—IL2 fusion proteins (e.g., ONTAK®) utilize the high affinity IL-2 receptor for entry into a target cell. Cells with higher levels of IL-2 receptor on their surface may internalize more diphtheria toxin and be killed more rapidly.

Tumor cells generally express higher levels of the high affinity IL-2 receptor and are the desired target for treatment. Thus, the administration of a diphtheria toxin exhibiting reduced cytotoxicity may result in the more specific killing of cells with the highest levels of IL-2 receptor (the desired targets) and reduction in the killing of cells with lower levels of IL-2 receptor, thus increasing the specificity of the therapy or treatment.

In addition to the modification in the (x)D/E(y) motifs, the modified DTs can further comprise a deletion or substitution of 1 to 30 amino acids of SEQ ID NO: 2, 148 or 200, 1 to 10 amino acids, or 1-3 amino acids, so long as the truncated molecule retains the ability to translocate into cells and kill target cells when the truncated molecule is fused with a cell binding domain.

In one embodiment provided herein is a modified diphtheria toxin, said modified diphtheria toxin having an amino acid sequence as set forth in SEQ ID NO. 2, 148 or 200 with one or more amino acid modifications therein, wherein at least one amino acid modification is made within an (x)D(y) motif in a region such as, for example, residues 7-9, 29-31 and 290-292 of SEQ ID NO 2, 148 or 200, and the modified diphtheria toxin has cytotoxicity comparable to an unmodified diphtheria toxin. In one embodiment, a modification at position (x) is a substitution of V or I by A, S, E, F, C, M, T, W, Y, P, H, Q, D, N, K, R, G, L, or a modified or unusual amino acid from Table 1. In one embodiment, a modification at position D is a substitution of D by A, S, E, I, V, L, F, C, M, G, T, W, Y, P, H, Q, N, K, R or a modified or unusual amino acid from Table 1. In one embodiment, a modification at position (y) is a substitution by I, F, C, M, A, G, T, W, Y, P, H, E, Q, D, N, K, R, S, L, V, and a modified or unusual amino acid from Table 1.

Alternatively, in another embodiment, provided herein is a modified diphtheria toxin having one or more amino acid modifications therein, wherein at least one amino acid modification is made within an (x)D/E(y) motif in a region selected from the group consisting of residues 7-9, 29-31 and 290-292 of SEQ ID NO 2, 148 or 200, and wherein said modified diphtheria toxin has cytotoxicity comparable to an unmodified diphtheria toxin. In one embodiment, a modification at position (x) is a substitution of V or I by F, C, M, T, W, Y, P, H, E, Q, D, N, K, R, or a modified or unusual amino acid from Table 1. In another embodiment, a modification at position D/E is a substitution of D/E by I, V, L, F, C, M, A, G, T, W, Y, P, H, Q, N, K, R or a modified or unusual amino acid from Table 1. In one embodiment, a modification at position (y) is a substitution by I, F, C, M, A, G, T, W, Y, P, H, E, Q, D, N, K, R, S, L, V, and a modified or unusual amino acid from Table 1.

In one embodiment, a modified diphtheria toxin contains one or more modifications. Such modified diphtheria toxins can contain mutations such as, for example, V7T, V7N, V7D, D8N, S9A, S9T, S9G, V29S, V29N, V29D, V29T, D30E, D30N, S31G, S31N, I290N, I290T, D291E, D291K, S292A, S292G and S292T.

In one embodiment, a modified diphtheria toxin contains two modifications. Such modified diphtheria toxins can contain a combination of mutations such as, for example, V7N V29N; V7N V29T; V7N V29D; V7T V29N; V7T V29T; and V7T V29D.

In one embodiment, a modified diphtheria toxin contains three modifications. Such modified diphtheria toxins can contain a combination of mutations such as, for example, V7N V29N I290N; V7N V29N I290T; V7N V29N S292A; V7N V29N S292T; V7N V29T I290N; V7N V29T I290T; V7N V29T S292A; V7N V29T S292T; V7T V29T I290T; V7N D30E I290T; V7N D30E I290N, V7N V29T D291K; V7N D30E D291K; V7N V29S I290T; V7T V29T S292A; V7T V29T S292T; and V7N V29D I290T.

Modified diphtheria toxins containing about 1, 2, 3, 4, 5, 6, 7, 8, 9, 10, 11, 12, 13, 14, 15, 16, 17, 18, 19, or up to about 20 modifications within one or more (x)D/E(y) motifs can be made, using the methods described herein, by sequentially modifying amino acid residues and comparing activity after each modification to the previously unmodified or previously modified diphtheria toxin. Alternatively, modified diphtheria toxins containing more than one modification can be made, using the methods described herein, by modifying two or more amino acid residues at the same time and comparing activity to the previously unmodified diphtheria toxin. Modified toxins can be tested for activity using assays known in the art and described herein including, but not limited to, cytotoxicity assays and ADP ribosylation assays.

Expressed toxin-mutants and toxin-fusion proteins can be tested for their functional activity. Methods for testing various toxins' activity are well-known in the art. For example, the VLS effect of DT-mutants and DT-fusion proteins can be tested in HUVECs as described in Example 2. The ribosyltransferase activity of DT variants or DT-fusion proteins can be tested by the ribosyltransferase assay described in Example 3. The cytotoxicity of DT variants or DT-fusion proteins can be tested as described in Example 4. VLS modified DT fusion toxins using these ligands are useful in treating cancers or other diseases of the cell type to which there is specific binding.

V. Toxins with T-Cell Epitope, B-Cell Epitope, and VLS Motif Modifications

In addition to the methods for reducing immunogenicity via modification of T-cell and B-cell epitopes and to the methods for reducing vascular leak syndrome via modification of VLS motifs as described herein, toxins and modified toxins can include both modifications to produce polypeptides that exhibit reduced immunogenicity (T-cell, B-cell, or both) and reduced capacity to cause vascular leak syndrome (i.e., reduced binding to endothelial cells and vascular endothelial cells and reduced disruption of endothelial cell junctions and other indications of vascular leak syndrome as described herein).

To produce a toxin (e.g., diphtheria toxin) that has modifications in T-cell epitopes, B-cell epitopes, VLS motifs, and combinations thereof, the amino acid residue modifications made for each type of modification are considered in light of the other modifications. In one non-limiting example, modification of both T-cell epitopes and VLS motifs is desired. When modifying both T-cell epitopes and VLS motifs, modification of at least one amino acid within at least one T-cell epitope within the toxin should not create a VLS motif. Similarly, the modification of at least one amino acid within at least one VLS motif within the toxin should not create a T-cell epitope. Additionally, the modification of a T-cell epitope or a VLS motif should not re-introduce a previously modified T-cell or VLS motif. Furthermore, modification of such polypeptides can also take into consideration the modification of B-cell epitopes, which when desired, should also not create or re-introduce T-cell epitopes or VLS motifs.

Modifications that affect the cytotoxicity of the toxins can also be made. For instance, if one or more modifications are made to one or more of a T cell epitope, a VLS motif and/or a B cell epitope are made and the cytotoxicity of the modified toxin is less than the unmodified toxin, it is contemplated herein that one or more modifications could made to restore the cytotoxicity to a level comparable to that of the unmodified toxin or to an effective level.

The membrane-inserting domain (translocation domain) of diphtheria toxin (T) contains an amphipathic region that is involved in the delivery of the catalytic (C) domain to the cytosol of a cell. In one non-limiting example, replacement of one or more amino acid residues of the amphipathic region with one or more different amino acid residues that retain the helical structure of the region can maintain cytotoxicity. Consideration of the composition and distribution of the charged and hydrophobic amino acid residues within the amphipathic region and modification thereof is also contemplated herein. Examples of charged amino residues include Glu, Asp, Asn, Gln, Lys, Arg and His; hydrophobic amino acids include, but are not limited to, alanine and phenylalanine.

Modification of the binding cleft of the catalytic domains of the ADP-ribosylating protein family, described herein, can also affect cytotoxicity. In one non-limiting example, modification of one or more amino acid residues of the F/Y-X-S-T-X motif of the diphtheria toxin C domain can affect the cytotoxicty of the polypeptide. Replacement of one or more amino acid residues in this region with one or more different amino acid residues that retain the catalytic domain can maintain cytotoxicity. Comparison with related members of the ADP-ribosylating protein family (e.g., *Pseudomonas aeruginosa* exotoxin A) can provide further guidance on amino acid residue modification and composition of domains such as the diphtheria toxin C domain. Modifications such as these are also contemplated herein.

Provided herein are methods of making modified toxins that have reduced immunogenicity, reduced VLS effects (i.e. reduced endothelial cell binding), and combinations thereof. Furthermore, methods of selecting modified toxins that have reduced immunogenicity, reduced VLS effects, and combinations thereof are also contemplated within the invention described herein. Exemplary constructs that are modified within T cell epitopes and VLS epitopes include, but are not limited to, V7N V29N I290N F124H L107A; V7N V29N S292A F124H L107A; V7N V29N S292T F124H L107A;

V7N V29T I290N F124H L107A; V7N V29T I290T F124H L107A; V7N V29T S292T F124H L107A; V7N V29T S292A F124H L107A; V7N V29N I290N F124H L107N; V7N V29N S282A F124H L107N; V7N V29N S292T F124H L107N; V7N V29T I290N F124H L107N; V7N V29T I290T F124H L107N; and V7N V29T S292A F124H L107N.

In one embodiment, a toxin is modified for T-cell epitopes, B-cell epitopes, VLS motifs, and combinations thereof, and the amino acid sequence of the modified toxin is subsequently examined for the creation or re-introduction of T-cell epitopes, B-cell epitopes, or VLS motifs. Where a T-cell epitope, B-cell epitope, VLS motif, or combination thereof is found to have been created or re-introduced, the amino acid residues therein are further modified to remove said T-cell epitope, B-cell epitope, VLS motif, or combination thereof without creating or re-introducing any T-cell epitope, B-cell epitope, VLS motif, or combinations thereof.

In another embodiment, T-cell epitopes within a toxin are first identified and modified, followed by identification and modification of any VLS motifs within the toxin. The modified toxin is then examined for the creation or re-introduction of any T-cell epitopes, and any such T-cell epitopes are modified without creating or re-introducing VLS motifs. In yet another embodiment, VLS motifs within a toxin are first identified and modified, followed by identification and modification of T-cell epitopes within the toxin.

Application of the methods described herein also provides for methods of making modified toxins that exhibit reduced immunogenicity, reduced VLS effects (i.e., reduced endothelial cell binding), and combinations thereof. Furthermore, methods of selecting modified toxins that have reduced immunogenicity, reduced VLS effects, and combinations thereof are also contemplated herein. Methods of testing modified toxins for such characteristics are known in the art and are described, for example, in the Examples provided herein. In one embodiment, a method of making a modified toxin exhibiting reduced immunogenicity and reduced VLS effects compared to an unmodified toxin comprises identifying at least one T-cell epitope within the amino acid sequence of a toxin, modifying at least one amino acid residue within at least one identified T-cell epitope, identifying at least one VLS motifs within the amino acid sequence of the toxin, and modifying at least one amino acid within at least one identified VLS motif.

In another embodiment, a modified toxin exhibiting reduced immunogenicity and reduced VLS effects compared to an unmodified toxin is produced by a process of identifying at least one T-cell epitope within the amino acid sequence of a toxin, modifying at least one amino acid residue within at least one identified T-cell epitope, identifying at least one VLS motifs within the amino acid sequence of the toxin, and modifying at least one amino acid within at least one identified VLS motif.

In yet another embodiment, a method of selecting a modified toxin that exhibits reduced immunogenicity and reduced VLS effects compared to an unmodified toxin comprises identifying at least one T-cell epitope within the amino acid sequence of a toxin, modifying at least one amino acid residue within at least one identified T-cell epitope, identifying at least one VLS motif within the amino acid sequence of the toxin, modifying at least one amino acid within at least one identified VLS motif, and selecting a modified toxin that exhibits reduced immunogenicity compared to an unmodified toxin.

VI. Toxins

As used herein, the term "toxin" refers to any anticellular agent, and includes, but is not limited to, cytotoxins and/or any combination of anticellular agents. In certain aspects, the toxin is, for example, a plant toxin, a fungal toxin, a bacterial toxin, a ribosome inactivating protein (RIP) or a combination thereof. Toxins include, but are not limited to, Abrin A chain, Diphtheria Toxin (DT) A-Chain, *Pseudomonas* exotoxin, RTA, Shiga Toxin A chain, Shiga-like toxin, Gelonin, Momordin, Pokeweed Antiviral Protein, Saporin, Trichosanthin, Barley toxin, and various other toxins known in the art. Toxin, as used herein, specifically excludes *Staphylococcus* enterotoxin B (SEB), hirudin, and bougainin proteins.

Diphtheria toxin is a member of the mono-ADP-ribosylating toxin family which further includes such toxins as cholera toxin, *pseudomonas* exotoxin A, pertussis toxin, and *clostridium* C3-like toxin. Members of this family contain many similar protein domains and motifs, in particular the catalytic site of the toxins. For example, the catalytic site of many members of this family is known to contain a glutamic acid residue important in the catalytic function of these toxins. The members of this family are contemplated as within the invention described herein using DT as an exemplary toxin. DT is composed of three domains: a catalytic domain; a transmembrane domain; and a receptor binding domain. The nucleic acid and amino acid sequences of native DT were described by Greenfield et al. PNAS (1983) 80: 6853-6857. Native DT is targeted to cells that express heparin binding epidermal growth factor-like receptors (Naglish et al., Cell, 69:1051-1061 (1992)). The first generation targeted toxins were initially developed by chemically cross-linking novel targeting ligands to toxins such as DT or mutants of DT deficient in cell binding (e.g. CRM45). The native cell binding domain or a cross-linked ligand that directs the DT toxophore to receptors on a specific class of receptor-bearing cells must possess intact catalytic and translocation domains. These domains are critical for delivery and intoxification of the targeted cell following receptor internalization. Once the toxin, toxin conjugate or fusion toxin has bound to the cell surface receptor the cell internalizes the toxin bound receptor via endocytic vesicles. As the vesicles are processed they become acidified and the translocation domain of the DT toxophore undergoes a structural reorganization which inserts the nine transmembrane segments of the toxin into the membrane of the endocytic vesicle. This event triggers the formation of a productive pore through which the catalytic domain of the toxin is threaded. Once translocated the catalytic domain which possess the ADP-ribosyltransferase activity is released into the cytosol of the targeted cell where it is free to poison translation thus effecting the death of the cell (reviewed in vanderSpek et al., Methods in Molecular Biology, Bacterial Toxins: methods and Protocols, 145:89-99, Humana press, Totowa, N.J., (2000)).

Fewer than ten molecules of DT will kill a cell if they enter the cytosol (although many times that number must bind to the cell surface because the entry process is inefficient). This extraordinary potency initially led to the concern that such poisons were too powerful to control. However, toxins such as DT can be rendered innocuous (except when directed to the target cells) simply by removing or modifying their cell-binding domain or subunit. The remaining portion of the toxin (lacking a cell-binding domain) is then coupled to a ligand (e.g., a polypeptide or portion thereof containing a cell-binding domain) that targets the toxic portion to the target cell. By selecting a polypeptide or portion thereof containing a cell-binding domain lacking unwanted cross-reactivity, fusion proteins are safer and have fewer non-specific cytotoxic effects than most conventional anti-cancer drugs. The other main attraction of toxins such as DT is that because they are inhibitors of protein synthesis, they kill resting cells as efficiently as dividing cells. Hence, tumor or infected cells that are not in cycle at the time of treatment do not escape the cytotoxic effect of a fusion protein.

Toxins such as DT often contain two disulfide-bonded chains, the A and B chains. The B chain carries both a cell-binding region and a translocation region, which facilitates the insertion of the A chain through the membrane of an acid intracellular compartment into the cytosol. The A chain then kills the cell after translocation. For their use in vivo, the ligand and toxin are coupled in such a way as to remain stable while passing through the bloodstream and the tissues and yet be labile within the target cell so that the toxic portion can be released into the cytosol.

However, it may be desirable from a pharmacologic standpoint to employ the smallest molecule possible that nevertheless provides an appropriate biological response. One may thus desire to employ smaller A chain peptides or other toxins which will provide an adequate anti-cellular response.

Diphtheria toxin as described herein comprises the amino acid sequence as set forth in SEQ ID NO: 2, 148 or 200. Additionally, variants of diphtheria are known to contain nucleic acid residue insertions, deletions, and/or substitutions in their nucleic acid sequence while still retaining their biological activity. Variants of diphtheria toxin have been characterized demonstrating nucleic acid variation among diphtheria toxins. (Holmes, R. K., *J. Infect. Dis.*, 181 (Supp. 1): S156-S167 (2000)), thus diphtheria toxins can comprise different nucleic acid and/or amino acid sequences. Nucleic acid residue insertions, deletions, and/or substitutions can also affect the amino acid sequence. However, not all nucleic acid residue changes will result in a change at the amino acid residue level of a protein due to the redundancy of the genetic code. Nucleic acid and/or amino acid variations (i.e., insertions, deletions, and/or substitutions) of diphtheria toxin are also included within the definition of diphtheria toxin and contemplated herein. As used herein, diphtheria toxin comprises the amino acid sequence as set forth in SEQ ID NO: 2, 148 or 200 and further includes diphtheria toxins comprising amino acid sequences about 90%, 91%, 92%, 93%, 94%, 95%, 96%, 97%, 98%, or 99% homologous to SEQ ID NO: 2, 148 or 200. C-terminal truncations of DT can also made and include for example, deletion of about 1, about 2, about 3, about 4, about 5, about 6, about 7, about 8, about 9, about 10, about 11, about 12, about 13, about 14, about 15, about 20, about 25, about 30, about 35, about 40, or about 50 amino acid residues of DT389 or DT387. For example, as used herein, diphtheria toxin comprises the amino acid sequence as set forth in amino acid residues 1-382 of SEQ ID NO: 2 or 149 and further includes diphtheria toxins comprising amino acid sequences about 90%, 91%, 92%, 93%, 94%, 95%, 96%, 97%, 98%, or 99% homologous to amino acid residues 1-382 of SEQ ID NO: 2 or 149. One would understand that variants of diphtheria toxin could be modified and tested for function using any of the methods described herein.

In one aspect, toxin as used herein contemplates fusion proteins between toxins (e.g. diphtheria toxin) and non-toxin polypeptides containing at least one cell binding domain. In one non-limiting example, a diphtheria toxin or a fragment thereof is fused to a cell-binding domain of interleukin 2 (IL-2), thus creating a fusion toxin. As described in further detail herein, fusion protein toxins can also comprise linker polypeptides and conjugates. Such toxins are also contemplated as toxins to be modified by the methods of the invention disclosed herein.

In one embodiment, a toxin is a fusion protein comprising a modified toxin wherein the toxin binding domain has been replaced with the binding domain of a non-toxin polypeptide. In another embodiment, the toxin is a fusion protein comprising a modified diphtheria toxin and a non-toxin polypeptide. In another embodiment, the toxin is a fusion protein comprising diphtheria toxin and IL-2.

While diphtheria toxin is frequently discussed as an exemplar toxin, one would recognize that the methods of the invention described herein can be applied to any of the aforementioned toxins.

VII. Fusion Proteins

The present invention also provides modified toxin fusion proteins. Modified toxin polypeptides can be fused to, for example, a non-toxin polypeptide. In one embodiment, the non-toxin polypeptide is a cell-specific binding ligand. The specific binding ligands used in the invention can contain an entire ligand, or a portion of a ligand which includes the entire binding domain of the ligand, or an effective portion of the binding domain. It is most desirable to include all or most of the binding domain of the ligand molecule. In one non-limiting example, a DT fusion protein contains a DT-related polypeptide (e.g., a modified DT described herein) and a non-DT polypeptide fused in-frame to each other. The DT-related polypeptide corresponds to all or a portion of DT variant having reduced immunogenicity or modified T-cell epitopes, reduced binding to human vascular endothelial cells, or combinations thereof. In one embodiment, a DT fusion protein comprises at least one portion of a modified DT sequence recited in one of SEQ ID NOS as set forth herein. In another embodiment, a DT fusion protein comprises at least one T-cell epitope modification. In a further embodiment, a DT fusion protein comprises at least one T-cell epitope modification, and at least one modification set forth in one or more of SEQ ID NOS as set forth herein. In a further embodiment, a DT fusion protein comprises at least one T-cell epitope modification, at least one modification set forth in one or more of SEQ ID NOS as set forth herein, and at least one B-cell epitope modification.

In one embodiment of the compounds disclosed herein, the modified toxin is a fusion toxin wherein a non-diphtheria toxin polypeptide is a cell-binding ligand. In a further embodiment, the cell-binding ligand is an antibody or antigen-binding fragment thereof, a cytokine, a polypeptide, a hormone, a growth factor, or insulin. In yet another embodiment, the cytokine is IL-2.

In another embodiment, the modified toxin is a fusion toxin wherein the cell binding domain is an antibody or antigen-binding fragment thereof. An antibody can be, for example, monoclonal, polyclonal, humanized, genetically engineered, or grafted. An antigen-binding fragment can be, for example, a Fab, Fab$_2$, a F(ab')$_2$, a scFv, a scFv2 (a tandem linkage of two scFv molecules head to tail in a chain), a single chain binding polypeptide, a VH or a VL. Methods of making antigen-binding fragments are known in the art and are incorporated herein. Useful antibodies include those that specifically bind to a receptor or other moiety expressed on the surface of the target cell membrane or tumor associated antigens.

"Specifically binds" means that the binding agent binds to the antigen on the target cell with greater affinity than it binds unrelated antigens. Preferably such affinity is at least about 10-fold greater, at least about 100-fold greater, or at least about 1000-fold greater than the affinity of the binding agent for unrelated antigens. The terms "immunoreactive" and "specifically binds" are used interchangeably herein. In certain embodiments, the anti-tumor antibodies or antigen-binding fragments thereof (e.g., scFv, scFv2, etc.) are those which recognize a surface determinant on the tumor cells and are internalized in those cells via receptor-mediated endocytosis. In a further embodiment, the antibody or antigen binding fragment thereof binds to a B-cell surface molecule such as, for example, the B-cell surface molecule is CD19 or CD22. Alternatively, the antibody or antigen binding fragment thereof, binds to the ovarian receptor MISIIR (Mullerian Inhibitory Substance type II receptor).

Cell specific-binding ligands can also include, but are not limited to: polypeptide hormones, e.g., those made using the binding domain of α-MSH can selectively bind to melanocytes, allowing the construction of improved t-MSH chimeric toxins useful in the treatment of melanoma. Other specific-binding ligands which can be used include insulin, somatostatin, and granulocyte colony stimulating factor. Other useful polypeptide ligands having cell-specific binding domains are follicle stimulating hormone (specific for ovarian cells), luteinizing hormone (specific for ovarian cells), thyroid stimulating hormone (specific for thyroid cells), vasopressin (specific for uterine cells, as well as bladder and intestinal cells), prolactin (specific for breast cells), and growth hormone (specific for certain bone cells). Specific-binding ligands which can be used include cytokines including, but not limited to, IL-1 (interleukin I), IL-2, IL-3 (also interleukin III), IL-4, IL-5, IL-6, IL-7, IL-8, IL-9, IL-10, IL-11, IL-12, IL-13, IL-14, IL-15, β-interferon, α-interferon (INF-α), INF-γ, angiostatin, thrombospondin, endostatin, METH-1, METH-2, GM-CSF, G-CSF, M-CSF, tumor necrosis factor (TNF), SVEGF, TGF-β, Flt3 and B-cell growth factor. IL-2 is of particular importance because of its role in allergic reactions and autoimmune diseases such as systemic lupus erythmatosis (SLE), involving activated T cells. Toxin fusion proteins made using B-cell growth factor can be used as immunosuppressant reagents which kill proliferating B-cells, which bear B-cell growth factor receptors, and which are involved in hypersensitivity reactions and organ rejection. Other cytokines include Substance P, VEGF, IL-3 and GM-CSF. Modified fusion toxins using these ligands are useful in treating cancers or other diseases of the cell type to which there is specific binding.

In IL-2, a LDL sequence (a "VLS" motif) at residues 19-21 (SEQ ID NO: 3 or 588) is located in an α-helix and is also partially exposed. Mutating Asp-20 to Lys in the LDL motif eliminates binding of IL-2 to the β chain of the IL-2 receptor and subsequent cell proliferation. It has been reported that IL-2 directly increases the permeability of the vascular endothelium to albumin in vitro and that this effect can be inhibited by anti-IL-2 receptor monoclonal antibodies. The LDL sequence in IL-2 damages HUVECs. The Asp-20 in the LDL of IL-2 is involved in receptor binding and functional activity. Thus, it is contemplated that in certain embodiments, mutations in IL-2's (x)D/E(y) sequence and/or flanking sequence(s) to eliminate or reduce VLS should be conservative with respect to Asp-20 or the biological activity of IL-2 may be reduced. In one embodiment, Asp-20 of IL2 is mutated to Threonine (T). In another embodiment, Asp-20 of IL2 is mutated to Lysine (K). In another embodiment, Asp-20 of IL2 is mutated to Asparagine (N).

In another embodiment, IL-2 can be mutated outside of a VLS motif. Modifications may also be made at one or more positions from 22 to 58 of IL-2. For example, IL-2 can be modified at one or more of positions 38, 39, 42 or 55. Non-limiting examples of modifications include, but are not limited to, N8R, R38G, R38W, R38G, R38Y, M39V, M39L, F42K and H55Y. Modifications may also be made at one or more positions such as, for example, K8, Q13, E15, H16, L19, D20, Q22, M23, L25, N26, N31, R38, L40, P42, K43, M46, K48, K49, T51, H79, L80, R81, D84, N88, V91, I92, E95, D109, E110, A112, T113, V115, E116, N119, R120, 1122, T123, Q126, 5127, 5130 and T131. Non-limiting examples of modifications include, but are not limited to, N88R, L85T, I86T, F42Y, F42A, F42K, E15A, E15R, L19A, L19R, N30E, K32E, N33D, P34G, T37I, M39Q, F42Y, F44Y, F42A, F44A, P47G, T51I, E52K, L53N, L56M, L56G, L56N, Q57E, N119A, N119R, F42A L19A, L19A N119A, T51A and T51P. Modifications also include deletions from the carboxy terminus of a cell binding domain. For example, residues 124-126 of the carboxy terminus of DT are deleted. In another example, residue 124 is deleted. In another example, residues 127-129 are deleted.

For a number of cell-specific ligands, the region within each such ligand in which the binding domain is located is now known. Furthermore, advances in solid phase polypeptide synthesis enable those skilled in this technology to determine the binding domain of practically any such ligand, by synthesizing various fragments of the ligand and testing them for the ability to bind to the class of cells to be labeled using conventional methods known in the art such as an ELISA assay. Thus, the chimeric genetic fusion toxins of the invention need not include an entire ligand, but rather can include only a fragment of a ligand which exhibits the desired cell-binding capacity. Likewise, analogs of the ligand or its cell-binding region having minor sequence variations can be synthesized, tested for their ability to bind to cells, and incorporated into the hybrid molecules of the invention. The amino acid sequences of cell-binding polypeptides can be analyzed for one or more VLS motifs, T-cell epitopes, B-cell epitopes, or combinations thereof and modified according to the concepts described herein.

In one aspect, a toxin-fusion protein of the present invention is produced by standard recombinant DNA techniques. For example, DNA fragments coding for the different polypeptide sequences are ligated together in-frame in accordance with conventional techniques, for example, by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence.

If needed for proper conformational folding of the fusion protein, a peptide linker sequence can be employed to separate the toxin-related polypeptide from non-toxin polypeptide components by a distance sufficient to ensure that each polypeptide folds into its secondary and tertiary structures. Such a peptide linker sequence can be incorporated into the fusion protein using standard techniques well known in the art and can be chosen based on the following factors: (1) its ability to adopt a flexible extended conformation; (2) its inability to adopt a secondary structure that could interact with functional epitopes on the toxin-related polypeptide and non-toxin polypeptide; and (3) the lack of hydrophobic or charged residues that might react with the polypeptide functional epitopes. Preferred peptide linker sequences contain Gly, Asn and Ser residues. Other near neutral amino acids, such as Thr and Ala, can also be used in the linker sequence. Amino acid sequences which can be usefully employed as linkers include, but are not limited to, those disclosed in Maratea et al., Gene, 40:39-46, 1985; Murphy et al., Proc. Natl. Acad. Sci. USA, 83:8258-8262, 1986; U.S. Pat. No. 4,935,233 and U.S. Pat. No. 4,751,180. The linker sequence can generally be from 1 to about 50 amino acids in length. Linker sequences may not be required when the toxin-related polypeptide and non-toxin polypeptide have non-essential N-terminal amino acid regions that can be used to separate the functional domains and prevent steric interference.

Chemical cross-linking or conjugation results in a variety of molecular species representing the reaction products, and typically only a small fraction of these products are catalytically and biologically active. In order to be biologically active, the reaction products must be conjugated in a manner that does not interfere with the innate structure and activity of the catalytic and translocation domains in the toxophore. Resolution of the active or highly active species from the inactive species is not always feasible as the reaction products often possess similar biophysical characteristics, including for example size, charge density and relative hydrophobicity. It is noteworthy that isolation of large amounts of pure clinical grade active product from chemically cross-linked toxins is not typically economically feasible for the production of pharmaceutical grade product for clinical trials and subsequent introduction to the clinical marketplace. To circumvent this issue, a genetic DT-based protein fusion toxin in which the native DT receptor-binding domain was genetically replaced with melanocyte-stimulating hormone as a surrogate receptor-targeting domain was created. This approach was used with human IL-2 as a surrogate targeting ligand to create DAB486IL-2 that was specifically cytotoxic only to those cells that expressed the high-affinity form of the IL-2 receptor. Subsequent studies of DAB486IL-2 indicated that truncation of 97 amino acids from the DT portion of the molecule resulted in a more stable, more cytotoxic version of the IL-2 receptor targeted toxin, DAB389IL-2. The original constructs (the 486 forms) still possessed a portion of the native DT cell binding domain. The DAB389 version contains the C and T domains of DT with the DT portion of the fusion protein ending in a random coil between the T domain and the relative receptor binding domain. A number of other targeting ligands have since been genetically fused to this DT toxophore, DAB389. Similar approaches have now been employed with other bacterial proteins and genetic fusion toxins are often easier to produce and purify.

VIII. Nucleic Acids, Vectors, and Host Cells

Another aspect of the present invention pertains to vectors containing a polynucleotide (nucleic acid, DNA) encoding a modified DT variant or a fusion protein thereof.

The nucleotide and polypeptide sequences for various genes have been previously disclosed, and can be found at computerized databases known to those of ordinary skill in the art. One such database is the National Center for Biotechnology Information's Genbank and GenPept databases. The coding regions for these known genes can be amplified and/or expressed using the techniques disclosed herein or by any technique that would be know to those of ordinary skill in the art. Additionally, polypeptide sequences can be synthesized by methods known to those of ordinary skill in the art, such as polypeptide synthesis using automated polypeptide synthesis machines, such as those available from Applied Biosystems (Foster City, Calif.).

As used herein, the term "expression vector or construct" means any type of genetic construct containing a nucleic acid coding for a gene product in which part or all of the nucleic acid encoding sequence is capable of being transcribed. The transcript can be translated into a protein, but it need not be. Thus, in certain embodiments, expression includes both transcription of a gene and translation of a RNA into a gene product. In other embodiments, expression only includes transcription of the nucleic acid, for example, to generate antisense constructs.

Particularly useful vectors are contemplated to be those vectors in which the coding portion of the DNA segment, whether encoding a full length protein, polypeptide or smaller peptide, is positioned under the transcriptional control of a promoter. A "promoter" refers to a DNA sequence recognized by the synthetic machinery of the cell, or introduced synthetic machinery, required to initiate the specific transcription of a gene. The phrases "operatively positioned," "under control" or "under transcriptional control" means that the promoter is in the correct location and orientation in relation to the nucleic acid coding for the gene product to control RNA polymerase initiation and expression of the gene.

The promoter can be in the form of the promoter that is naturally associated with a gene, as can be obtained by isolating the 5' non-coding sequences located upstream of the coding segment or exon, for example, using recombinant cloning and/or PCR technology, in connection with the compositions disclosed herein.

In other embodiments, it is contemplated that certain advantages will be gained by positioning the coding DNA segment under the control of a recombinant, or heterologous, promoter. As used herein, a recombinant or heterologous promoter is intended to refer to a promoter that is not normally associated with a gene in its natural environment. Such promoters can include promoters normally associated with other genes, and/or promoters isolated from any other bacterial, viral, eukaryotic, or mammalian cell, and/or promoters made by the hand of man that are not "naturally occurring," that is, containing difference elements from different promoters, or mutations that increase, decrease or alter expression.

Promoters that effectively direct the expression of the DNA segment in the cell type, organism, or even animal, are chosen for expression. The use of promoter and cell type combinations for protein expression is generally known to those of skill in the art of molecular biology, for example, see Sambrook et al., (1989), incorporated herein by reference. The promoters employed can be constitutive, or inducible, and can be used under the appropriate conditions to direct high level expression of the introduced DNA segment, such as is advantageous in the large-scale production of recombinant proteins or peptides.

At least one module in a promoter generally functions to position the start site for RNA synthesis. The best known example of this is the TATA box, but in some promoters lacking a TATA box, such as the promoter for the mammalian terminal deoxynucleotidyl transferase gene and the promoter for the SV40 late genes, a discrete element overlying the start site itself helps to fix the place of initiation.

Additional promoter elements regulate the frequency of transcriptional initiation. Typically, these are located in the region 30-110 base pairs (bp) upstream of the start site, although a number of promoters have been shown to contain functional elements downstream of the start site as well. The spacing between promoter elements frequently is flexible, so that promoter function is preserved when elements are inverted or moved relative to one another. In the tk promoter, the spacing between promoter elements can be increased to 50 bp apart before activity begins to decline. Depending on the promoter, it appears that individual elements can function either co-operatively or independently to activate transcription.

The particular promoter that is employed to control the expression of a nucleic acid is not believed to be critical, so long as it is capable of expressing the nucleic acid in the targeted cell. Thus, where a human cell is targeted, it is preferable to position the nucleic acid coding region adjacent to and under the control of a promoter that is capable of being expressed in a human cell. Generally speaking, such a promoter might include either a human or viral promoter.

In expression, one will typically include a polyadenylation signal to effect proper polyadenylation of the transcript. The nature of the polyadenylation signal is not believed to be crucial to the successful practice of the invention, and any such sequence may be employed. Polyadenylation signals include, but are not limited to the SV40 polyadenylation signal and the bovine growth hormone polyadenylation signal, convenient and known to function well in various target cells. Also contemplated as an element of the expression cassette is a terminator sequence. These elements can serve to enhance message levels and to minimize read through from the cassette into other sequences.

A specific initiation signal also can be required for efficient translation of coding sequences. These signals include the ATG initiation codon and adjacent sequences. Exogenous translational control signals, including the ATG initiation codon, may need to be provided. One of ordinary skill in the art would readily be capable of determining this and providing the necessary signals. It is well known that the initiation codon must be "in-frame" with the reading frame of the desired coding sequence to ensure translation of the entire insert. The exogenous translational control signals and initiation codons can be either natural or synthetic. The efficiency of expression may be enhanced by the inclusion of appropriate transcription enhancer elements.

It is contemplated that polypeptides can be co-expressed with other selected proteins, wherein the proteins can be co-expressed in the same cell or a gene(s) can be provided to a cell that already has another selected protein. Co-expression can be achieved by co-transfecting the cell with two distinct recombinant vectors, each bearing a copy of either of the respective DNA. Alternatively, a single recombinant vector can be constructed to include the coding regions for both of the proteins, which could then be expressed in cells transfected with the single vector. In either event, the term "co-expression" herein refers to the expression of both the gene(s) and the other selected protein in the same recombinant cell.

As used herein, the terms "engineered" and "recombinant" cells or host cells are intended to refer to a cell into which an exogenous DNA segment or gene, such as a cDNA or gene encoding a protein has been introduced. Therefore, engineered cells are distinguishable from naturally occurring cells which do not contain a recombinantly introduced exogenous DNA segment or gene. Engineered cells are thus cells having a gene or genes introduced through the hand of man. Recombinant cells include those having an introduced cDNA or genomic gene, and also include genes positioned adjacent to a promoter not naturally associated with the particular introduced gene.

To express a recombinant polypeptide, whether modified or wild-type, in accordance with the present invention one would prepare an expression vector that comprises a wild-type, or modified protein-encoding nucleic acid under the control of one or more promoters. To bring a coding sequence "under the control of" a promoter, one positions the 5' end of the transcription initiation site of the transcriptional reading frame generally between about 1 and about 50 nucleotides "downstream" of (i.e., 3' of) the chosen promoter. The "upstream" promoter stimulates transcription of the DNA and promotes expression of the encoded recombinant protein. This is the meaning of "recombinant expression" in this context.

Many standard techniques are available to construct expression vectors containing the appropriate nucleic acids and transcriptional/translational control sequences in order to achieve protein, polypeptide or peptide expression in a variety of host-expression systems. Cell types available for expression include, but are not limited to, bacteria, such as *E. coli* and *B. subtilis* transformed with recombinant bacteriophage DNA, plasmid DNA or cosmid DNA expression vectors.

Certain examples of prokaryotic hosts are *E. coli* strain RR1, *E. coli* LE392, *E. coli* B, *E. coli* X 1776 (ATCC No. 31537) as well as *E. coli* W3110 (F-, lambda-, prototrophic, ATCC No. 273325); bacilli such as *Bacillus subtilis*; and other enterobacteriaceae such as *Salmonella typhimurium, Serratia marcescens*, and various *Pseudomonas* species.

In general, plasmid vectors containing replicon and control sequences which are derived from species compatible with the host cell are used in connection with these hosts. The vector ordinarily carries a replication site, as well as marking sequences which are capable of providing phenotypic selection in transformed cells. For example, *E. coli* is often transformed using derivatives of pBR322, a plasmid derived from an *E. coli* species. pBR322 contains genes for ampicillin and tetracycline resistance and thus provides easy means for identifying transformed cells. The pBR plasmid, or other microbial plasmid or phage must also contain, or be modified to contain, promoters which can be used by the microbial organism for expression of its own proteins.

In addition, phage vectors containing replicon and control sequences that are compatible with the host microorganism can be used as transforming vectors in connection with these hosts. For example, the phage lambda GEM™-11 may be utilized in making a recombinant phage vector which can be used to transform host cells, such as *E. coli* LE392.

Further useful vectors include pIN vectors (Inouye et al., 1985); and pGEX vectors, for use in generating glutathione S-transferase (GST) soluble fusion proteins for later purification and separation or cleavage. Other suitable fusion proteins are those with β-galactosidase, ubiquitin, and the like.

Promoters that are most commonly used in recombinant DNA construction include the β-lactamase (penicillinase), lactose and tryptophan (trp) promoter systems. While these are the most commonly used, other microbial promoters have been discovered and utilized, and details concerning their nucleotide sequences have been published, enabling those of skill in the art to ligate them functionally with plasmid vectors.

The following details concerning recombinant protein production in bacterial cells, such as *E. coli*, are provided by way of exemplary information on recombinant protein production in general, the adaptation of which to a particular recombinant expression system will be known to those of skill in the art.

Bacterial cells, for example, E. coli, containing the expression vector are grown in any of a number of suitable media, for example, LB. The expression of the recombinant protein may be induced, e.g., by adding IPTG to the media or by switching incubation to a higher temperature. After culturing the bacteria for a further period, generally of between 2 and 24 hours (h), the cells are collected by centrifugation and washed to remove residual media.

The bacterial cells are then lysed, for example, by disruption in a cell homogenizer and centrifuged to separate the dense inclusion bodies and cell membranes from the soluble cell components. This centrifugation can be performed under conditions whereby the dense inclusion bodies are selectively enriched by incorporation of sugars, such as sucrose, into the buffer and centrifugation at a selective speed.

If the recombinant protein is expressed in the inclusion bodies, as is the case in many instances, these can be washed in any of several solutions to remove some of the contaminating host proteins, then solubilized in solutions containing high concentrations of urea (e.g., 8 M) or chaotropic agents such as guanidine hydrochloride in the presence of reducing agents, such as β-mercaptoethanol or DTT (dithiothreitol).

It is contemplated that the polypeptides produced by the methods described herein can be overexpressed, i.e., expressed in increased levels relative to its natural expression in cells. Such overexpression can be assessed by a variety of methods, including radio-labeling and/or protein purification. However, simple and direct methods are preferred, for example, those involving SDS/PAGE and protein staining or western blotting, followed by quantitative analyses, such as densitometric scanning of the resultant gel or blot. A specific increase in the level of the recombinant protein, polypeptide or peptide in comparison to the level in natural cells is indicative of overexpression, as is a relative abundance of the specific polypeptides in relation to the other proteins produced by the host cell and, e.g., visible on a gel.

Expression vectors provided herein comprise a polynucleotide encoding modified DT or a fusion protein thereof in a form suitable for expression of the polynucleotide in a host cell. The expression vectors generally have one or more regulatory sequences, selected on the basis of the host cells to be used for expression, which is operatively linked to the polynucleotide sequence to be expressed. It will be appreciated by those skilled in the art that the design of the expression vector can depend on such factors as the choice of the host cell to be transformed, the level of expression of protein desired, and the like. The expression vectors described herein can be introduced into host cells to produce proteins, including fusion proteins, encoded by polynucleotides as described herein (e.g., a modified DT or a DT fusion protein, and the like).

Expression vectors can be designed for expression of a modified DT or a DT fusion protein in prokaryotic or eukaryotic cells. The presence of a single DT gene inside a eukaryotic cell would kill the cell. Specifically, the toxin binds to EF-2 which is required for translation and ribosylation. Accordingly, DT can only be expressed in eukaryotic cells with modified EF-2 that is no longer recognized by DT (see, e.g., Liu et al., Protein Expr Purif, 30:262-274 (2003); Phan et al., J. Biol. Chem., 268(12):8665-8 (1993); Chen et al., Mol. Cell Biol., 5(12):3357-60 (1985); Kohne et al., Somat Cell Mol. Genet., 11(5):421-31 (1985); Moehring et al., Mol. Cell Biol., 4(4):642-50 (1984)). In addition, a modified DT or a fusion protein thereof can be expressed in bacterial cells such as E. coli (Bishai et al., J Bacteriol 169(11):5140-51 (1987)). Consideration is given to the expression and activity of the types and levels of host protease expression, and this is dependent upon the cleavage site present in the engineered DT toxophore. The innate expression host protease expression profile could negatively impact the yields of DT fusion toxin produced (Bishai et al., supra (1987)). To the degree that this requisite cleavage site can be altered to modulate the cell selectivity of resultant fusion proteins, it is envisioned that such cleavage site mutants could be in VLS-modified toxophores (Gordon et al., Infect Immun, 63(1):82-7 (1995); Gordon et al., Infect Immun, 62(2):333-40 (1994); Vallera et al., J Natl. Cancer Inst., 94:597-606 (2002); Abi-Habib et al., Blood., 104(7): 2143-8 (2004)). Alternatively, the expression vector can be transcribed and translated in vitro.

The present application further provides gene delivery vehicles for the delivery of polynucleotides to cells, tissue, or a mammal for expression. For example, a polynucleotide sequence of the present invention can be administered either locally or systemically in a gene delivery vehicle. These constructs can utilize viral or non-viral vector approaches in in vivo or ex vivo modality. Expression of such coding sequences can be induced using endogenous mammalian or heterologous promoters. Expression of the coding sequence in vivo can be either constitutive or regulated. The invention includes gene delivery vehicles capable of expressing the contemplated polynucleotides including viral vectors. For example, Qiao et al. developed a system employing PG13 packaging cells produce recombinant retroviruses carrying a DT fragment which kills cancer cell and provides a method for using DT as component a suicide vector. Qiao et al., J. Viol. 76(14):7343-8 (2002).

Expressed DT-mutants and DT-fusion proteins can be tested for their functional activity. Methods for testing DT activity are well-known in the art. For example, the VLS effect of DT-mutants and DT-fusion proteins can be tested in HUVECs as described in Example 2. The ribosyltransferase activity of DT variants or DT-fusion proteins can be tested by the ribosyltransferase assay described in Example 3. The cytotoxicity of DT variants or DT-fusion proteins can be tested as described in Example 4.

The present application also provides purified, and in preferred embodiments, substantially purified, polypeptides expressed using one or more of the methods described herein. The term "purified" as used herein, is intended to refer to a proteinaceous composition, isolatable from mammalian cells or recombinant host cells, wherein at least one polypeptide is purified to any degree relative to its naturally-obtainable state, i.e., relative to its purity within a cellular extract. A purified polypeptide therefore also refers to a wild-type or modified polypeptide free from the environment in which it naturally occurs.

Where the term "substantially purified" is used, this will refer to a composition in which the specific polypeptide forms the major component of the composition, such as constituting about 50% of the proteins in the composition or more. In one embodiment, a substantially purified polypeptide will constitute more than about 60%, about 70%, about 80%, about 90%, about 95%, about 99% or even more of the polypeptides in the composition.

A polypeptide that is "purified to homogeneity," as applied to the present invention, means that the polypeptide has a level of purity where the polypeptide is substantially free from other proteins and biological components. For example, a purified polypeptide will often be sufficiently free of other protein components so that degradative sequencing can be performed.

Various methods for quantifying the degree of purification of polypeptides will be known to those of skill in the art in light of the present disclosure. These include, for example, determining the specific protein activity of a fraction, or assessing the number of polypeptides within a fraction by gel electrophoresis.

To purify a desired polypeptide, a natural or recombinant composition comprising at least some specific polypeptides will be subjected to fractionation to remove various other components from the composition. In addition to those techniques described in detail herein below, various other techniques suitable for use in protein purification will be well known to those of skill in the art. These include, for example, precipitation with ammonium sulfate, PEG, antibodies and the like or by heat denaturation, followed by centrifugation; chromatography steps such as ion exchange, gel filtration, reverse phase, hydroxylapatite, lectin affinity and other affinity chromatography steps; isoelectric focusing; gel electrophoresis; and combinations of such and other techniques.

Another example is the purification of a specific fusion protein using a specific binding partner. Such purification methods are routine in the art. As the present invention provides DNA sequences for the specific proteins, any fusion protein purification method can now be practiced. This is exemplified by the generation of a specific protein-glutathione S-transferase fusion protein, expression in *E. coli*, and isolation to homogeneity using affinity chromatography on glutathione-agarose or the generation of a polyhistidine tag on the N- or C-terminus of the protein, and subsequent purification using Ni-affinity chromatography. However, given many DNA and proteins are known, or may be identified and amplified using the methods described herein, any purification method can now be employed.

There is no general requirement that the polypeptides always be provided in their most purified state. Indeed, it is contemplated that less substantially purified polypeptides which are nonetheless enriched in the desired protein compositions, relative to the natural state, will have utility in certain embodiments. Polypeptides exhibiting a lower degree of relative purification may have advantages in total recovery of protein product, or in maintaining the activity of an expressed protein.

Provided herein is a method for making a composition comprising: (a) constructing a vector comprising a polynucleotide which encodes a polypeptide having a modified diphtheria toxin amino acid sequence set forth herein, and (b) causing said polypeptide to be expressed in a host cell comprising said vector. In one embodiment, a composition produced by such a method, wherein said composition has a reduced binding activity to human vascular endothelial cells (HUVEC) compared to a DT molecule having a sequence of SEQ ID NO: 2, 148 or 200. Further provided herein is a method for making a composition, comprising: (a) constructing a vector comprising a polynucleotide which encodes a toxin having at least one T-cell epitope modification, and (b) causing said polypeptide to be expressed in a host cell comprising said vector. In one embodiment, a composition produced by such a method wherein the toxin is DT. In one embodiment, a composition produced by such a method, wherein said composition has a reduced immunogenicity compared to a DT molecule having a sequence of SEQ ID NO: 2, 148 or 200.

Provided herein is a method for making a modified toxin having a reduced immunogenicity compared to an unmodified toxin, said method comprising the step of: (a) constructing a vector comprising a nucleic acid sequence encoding a toxin, said modified diphtheria toxin comprising a diphtheria toxin having an amino acid sequence as recited in SEQ ID NO: 2 with one or more amino acid modifications therein, wherein at least one amino acid modification is made within a T-cell epitope, and wherein said modified diphtheria toxin has cytotoxicity comparable to an unmodified diphtheria toxin, and (b) causing said polypeptide to be expressed in a host cell comprising said vector.

Further embodiments include a method for making a modified diphtheria toxin having a reduced immunogenicity and reduced binding activity to human vascular endothelial cells (HUVEC) compared to an unmodified diphtheria toxin, said method comprising the step of: (a) constructing a vector comprising a nucleic acid sequence encoding a modified diphtheria toxin, said modified diphtheria toxin comprising a diphtheria toxin having an amino acid sequence as recited in SEQ ID NO: 2, 148 or 200 with one or more amino acid modifications therein, wherein at least one amino acid modification is made within a T-cell epitope, within an (x)D(y) motif in a region selected from the group consisting of residues 7-9, 29-31 and 290-292 of SEQ ID NO: 2, 148 or 200, within a B-cell epitope, or combinations thereof, and wherein said modified diphtheria toxin has cytotoxicity comparable to an unmodified diphtheria toxin, and (b) causing said polypeptide to be expressed in a host cell comprising said vector. In one non-limiting example, a modified VLS (x)D/E(y) motif can be a modification at position (x) that is a substitution of V or I by an amino acid residue selected from among A, S, E, F, C, M, T, W, Y, P, H, Q, D, N, K, R, G, L and a modified or unusual amino acid from Table 1; and wherein a modification at position D/E is a substitution of D/E by an amino acid residue selected from among A, S, E, I, V, L, F, C, M, G, T, W, Y, P, H, Q, N, K, R and a modified or unusual amino acid from Table 1. In one embodiment, a modification at position (y) is a substitution by I, F, C, M, A, G, T, W, Y, P, H, E, Q, D, N, K, R, S, L, V, and a modified or unusual amino acid from Table 1.

By way of example only, unmodified diphtheria toxins can have, for example, an amino acid sequence of SEQ ID NO: 2, 148 or 200.

The present application also contemplates that modified proteins can be created in a step-wise or sequential fashion such that some modifications are made and then one or more subsequent rounds of modification(s) are made. Such sequential or step-wise modifications represent one way of carrying out the process and one way of producing the modified proteins described herein claimed herein.

Bacterial and plant holotoxins often contain two disulfide-bonded chains, the A and B chains. The B chain carries both a cell-binding region (whose receptor is often uncharacterized) and a translocation region, which facilitates the insertion of the A chain through the membrane of an acid intracellular compartment into the cytosol. The A chain then kills the cell after incorporation. For their use in vivo, the ligand and toxin are coupled in such a way as to remain stable while passing through the bloodstream and the tissues and yet be labile within the target cell so that the toxic portion can be released into the cytosol. However, it may be desirable from a pharmacologic standpoint to employ the smallest molecule possible that nevertheless provides an appropriate biological response. One can, thus, desire to employ smaller A chain peptides which will provide an adequate anti-cellular response. To this end, DT can be "truncated" and still retain an adequate toxin activity. It is proposed that where desired, this truncated A chain can be employed in fusion proteins in accordance with the embodiments described herein.

Alternatively, one may find that the application of recombinant DNA technology to the toxin moiety may provide additional benefits. In that biologically active DT has now been cloned and recombinantly expressed, it is now possible to identify and prepare smaller or otherwise variant peptides which nevertheless exhibit an appropriate toxin activity. Moreover, the fact that DT has now been cloned allows the application of site-directed mutagenesis through which one can readily prepare and screen for DT A chain, toxin-derived peptides and obtain additional useful moieties for use in connection with the presently described compounds. Once identified, these moieties can be mutated to produce toxins exhibiting a reduced ability to promote VLS, EC damaging activity and/or other effects of such sequences described herein or known to one of skill in the art.

Provided herein is a fusion protein comprising a modified diphtheria toxin made by such methods and a non-diphtheria toxin polypeptide, wherein said non-diphtheria toxin polypeptide is selected from among an antibody or antigen-binding fragment thereof, EGF, IL-1, IL-2, IL-3, IL-4, IL-5, IL-6, IL-7, IL-8, IL-9, IL-10, IL-11, IL-12, IL-13, IL-14, IL-15, INFα, INFγ, GM-CSF, G-CSF, M-CSF, TNF, VEGF, Ephrin, BFGF, TGF, and a cell-binding portion thereof. In one embodiment, the non-diphtheria toxin polypeptide is, for example, IL-2 or a cell binding portion thereof. In certain embodiments, the fusion protein or toxin further comprises at least another agent. Such an agent can be a molecule or moiety including, but not limited to, at least one effector (therapeutic moiety) or reporter molecule (a detectable label) as described elsewhere herein.

IX. Detectable Labels

The present invention provides fusion proteins against target epitopes, such as epitopes expressed on a diseased tissue or a disease-causing cell (e.g., IL-2 receptors on cancer cells). In certain embodiments the fusion protein comprises a modified DT described herein. In other embodiments the fusion protein further comprises a second agent. Such an agent can be a molecule or moiety such as, for example, a reporter molecule or a detectable label. Reporter molecules are any moiety which can be detected using an assay. Non-limiting examples of reporter molecules which have been conjugated to polypeptides include enzymes, radiolabels, haptens, fluorescent labels, phosphorescent molecules, chemiluminescent molecules, chromophores, luminescent molecules, photoaffinity molecules, colored particles or ligands, such as biotin. Detectable labels include compounds and/or elements that can be detected due to their specific functional properties, and/or chemical characteristics, the use of which allows the polypeptide to which they are attached to be detected, and/or further quantified if desired. Many appropriate detectable (imaging) agents are known in the art, as are methods for their attachment to polypeptides (see, for e.g., U.S. Pat. Nos. 5,021,236; 4,938,948; and 4,472,509, each incorporated herein by reference). The imaging moieties used can be paramagnetic ions; radioactive isotopes; fluorochromes; NMR-detectable substances; X-ray imaging. Molecules containing azido groups can also be used to form covalent bonds to proteins through reactive nitrene intermediates that are generated by low intensity ultraviolet light (Potter & Haley, 1983). In particular, 2- and 8-azido analogues of purine nucleotides have been used as site-directed photoprobes to identify nucleotide binding proteins in crude cell extracts (Owens & Haley, 1987; Atherton et al., 1985). The 2- and 8-azido nucleotides have also been used to map nucleotide binding domains of purified proteins (Khatoon et al., 1989; King et al., 1989; and Dholakia et al., 1989) and can be used as polypeptide binding agents.

X. Compositions and Therapeutic Uses

Each of the compounds described herein can be used as a composition when combined with an acceptable carrier or excipient. Such compositions are useful for in vitro analysis or for administration to a subject in vivo or ex vivo for treating a subject with the disclosed compounds.

Thus pharmaceutical compositions can comprise, in addition to active ingredient, a pharmaceutically acceptable excipient, carrier, buffer, stabilizer or other materials well known to those skilled in the art. Such materials should be non-toxic and should not interfere with the efficacy of the active ingredient. The precise nature of the carrier or other material will depend on the route of administration.

Pharmaceutical formulations comprising a protein of interest, e.g., an antibody, identified by the methods described herein can be prepared for storage by mixing the protein having the desired degree of purity with optional physiologically acceptable carriers, excipients or stabilizers (Remington's Pharmaceutical Sciences 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN®, PLURONICS® or polyethylene glycol (PEG).

The formulation described herein can also contain more than one active compound as necessary for the particular indication being treated. Such molecules are suitably present in combination in amounts that are effective for the purpose intended.

Acceptable carriers are physiologically acceptable to the administered patient and retain the therapeutic properties of the compounds with/in which it is administered. Acceptable carriers and their formulations are and generally described in, for example, Remington' pharmaceutical Sciences (18th Edition, ed. A. Gennaro, Mack Publishing Co., Easton, Pa. 1990). One exemplary carrier is physiological saline. The phrase "pharmaceutically acceptable carrier" as used herein means a pharmaceutically acceptable material, composition or vehicle, such as a liquid or solid filler, diluent, excipient, solvent or encapsulating material, involved in carrying or transporting the subject compounds from the administration site of one organ, or portion of the body, to another organ, or portion of the body, or in an in vitro assay system. Each carrier must be "acceptable" in the sense of being compatible with the other ingredients of the formulation and not injurious to a subject to whom it is administered. Nor should an acceptable carrier alter the specific activity of the subject compounds. Exemplary carriers and excipients have been provided elsewhere herein.

In one aspect, provided herein are pharmaceutically acceptable or physiologically acceptable compositions including solvents (aqueous or non-aqueous), solutions, emulsions, dispersion media, coatings, isotonic and absorption promoting or delaying agents, compatible with pharmaceutical administration. Pharmaceutical compositions or pharmaceutical formulations therefore refer to a composition suitable for pharmaceutical use in a subject. The pharmaceutical compositions and formulations include an amount of a compound described herein, for example, an effective amount of modified fusion protein described herein, and a pharmaceutically or physiologically acceptable carrier.

Compositions can be formulated to be compatible with a particular route of administration, systemic or local. Thus, compositions include carriers, diluents, or excipients suitable for administration by various routes. Pharmaceutical compositions for oral administration may be in tablet, capsule, powder or liquid form. A tablet may comprise a solid carrier such as gelatin or an adjuvant. Liquid pharmaceutical compositions generally comprise a liquid carrier such as water, petroleum, animal or vegetable oils, mineral oil or synthetic oil. Physiological saline solution, dextrose or other saccharide solution or glycols such as ethylene glycol, propylene glycol or polyethylene glycol may be included.

In a further embodiment, the compositions can further comprise, if needed, an acceptable additive in order to improve the stability of the compounds in composition and/or to control the release rate of the composition. Acceptable additives do not alter the specific activity of the subject compounds. Exemplary acceptable additives include, but are not limited to, a sugar such as mannitol, sorbitol, glucose, xylitol, trehalose, sorbose, sucrose, galactose, dextran, dextrose, fructose, lactose and mixtures thereof. Acceptable additives can be combined with acceptable carriers and/or excipients such as dextrose. Alternatively, exemplary acceptable additives include, but are not limited to, a surfactant such as polysorbate 20 or polysorbate 80 to increase stability of the peptide and decrease gelling of the solution. The surfactant can be added to the composition in an amount of 0.01% to 5% of the solution. Addition of such acceptable additives increases the stability and half-life of the composition in storage.

The pharmaceutical composition can be administered subcutaneously, intramuscularly, intraperitoneally, orally or intravenously. Aerosol delivery of the compositions is also contemplated herein using conventional methods. For example, intravenous delivery is now possible by cannula or direct injection or via ultrasound guided fine needle. Mishra (Mishra et al., Expert Opin. Biol., 3(7):1173-1180 (2003)) provides for intratumoral injection.

Formulations for enteral (oral) administration can be contained in a tablet (coated or uncoated), capsule (hard or soft), microsphere, emulsion, powder, granule, crystal, suspension, syrup or elixir. Conventional non-toxic solid carriers which include, for example, pharmaceutical grades of mannitol, lactose, starch, magnesium stearate, sodium saccharin, talcum, cellulose, glucose, sucrose, magnesium carbonate, can be used to prepare solid formulations. Supplementary active compounds (e.g., preservatives, antibacterial, antiviral and antifungal agents) can also be incorporated into the formulations. A liquid formulation can also be used for enteral administration. The carrier can be selected from various oils including petroleum, animal, vegetable or synthetic, for example, peanut oil, soybean oil, mineral oil, sesame oil. Suitable pharmaceutical excipients include e.g., starch, cellulose, talc, glucose, lactose, sucrose, gelatin, malt, rice, flour, chalk, silica gel, magnesium stearate, sodium stearate, glycerol monostearate, sodium chloride, dried skim milk, glycerol, propylene glycol, water, ethanol.

Compositions for injection include aqueous solutions (where water soluble) or dispersions and sterile powders for the extemporaneous preparation of sterile injectable solutions or dispersions. For intravenous administration, suitable carriers include physiological saline, bacteriostatic water, Cremophor EL™ (BASF, Parsippany, N.J.) or phosphate buffered saline (PBS). The carrier can be a solvent or dispersion medium containing, for example, water, ethanol, polyol (for example, glycerol, propylene glycol, and liquid polyetheylene glycol, and the like), and suitable mixtures thereof. Fluidity can be maintained, for example, by the use of a coating such as lecithin, by the maintenance of the required particle size in the case of dispersion and by the use of surfactants. Antibacterial and antifungal agents include, for example, parabens, chlorobutanol, phenol, ascorbic acid and thimerosal. Isotonic agents, for example, sugars, polyalcohols such as manitol, sorbitol, and sodium chloride may be included in the composition. The resulting solutions can be packaged for use as is, or lyophilized; the lyophilized preparation can later be combined with a sterile solution prior to administration.

Compositions can be conventionally administered intravenously, such as by injection of a unit dose, for example. For injection, an active ingredient can be in the form of a parenterally acceptable aqueous solution which is substantially pyrogen-free and has suitable pH, isotonicity and stability. One can prepare suitable solutions using, for example, isotonic vehicles such as Sodium Chloride Injection, Ringer's Injection, Lactated Ringer's Injection. Preservatives, stabilizers, buffers, antioxidants and/or other additives may be included, as required.

In one embodiment, the composition is lyophilized. When the compositions are considered for medicaments, or use in any of the methods provided herein, it is contemplated that the composition can be substantially free of pyrogens such that the composition will not cause an inflammatory reaction or an unsafe allergic reaction.

Acceptable carriers can contain a compound that stabilizes, increases or delays absorption or clearance. Such compounds include, for example, carbohydrates, such as glucose, sucrose, or dextrans; low molecular weight proteins; compositions that reduce the clearance or hydrolysis of peptides; or excipients or other stabilizers and/or buffers. Agents that delay absorption include, for example, aluminum monostearate and gelatin. Detergents can also be used to stabilize or to increase or decrease the absorption of the pharmaceutical composition, including liposomal carriers. To protect from digestion the compound can be complexed with a composition to render it resistant to acidic and enzymatic hydrolysis, or the compound can be complexed in an appropriately resistant carrier such as a liposome. Means of protecting compounds from digestion are known in the art (see, e.g., Fix (1996) Pharm Res. 13:1760 1764; Samanen (1996) J. Pharm. Pharmacol. 48:119 135; and U.S. Pat. No. 5,391,377, describing lipid compositions for oral delivery of therapeutic agents).

For intravenous, injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilizers, buffers, antioxidants and/or other additives may be included, as needed.

The phrase "pharmaceutically acceptable" refers to molecular entities and compositions that are physiologically tolerable and do not typically produce an allergic or similar untoward reaction, such as gastric upset, dizziness and the like, when administered to a human.

The term "unit dose" when used in reference to a therapeutic composition refers to physically discrete units suitable as unitary dosage for humans, each unit containing a predetermined quantity of active material calculated to produce the desired therapeutic effect in association with the required diluent; i.e., carrier, or vehicle.

The compositions can be administered in a manner compatible with the dosage formulation, and in a therapeutically effective amount. The quantity to be administered depends on the subject to be treated, capacity of the subject's immune system to utilize the active ingredient, and degree of binding capacity desired. Precise amounts of active ingredient required to be administered depend on the judgment of the practitioner and are peculiar to each individual. Suitable regimes for initial administration and booster shots are also variable, but are typified by an initial administration followed by repeated doses at one or more hour intervals by a subsequent injection or other administration. Alternatively, continuous intravenous infusion sufficient to maintain concentrations of ten nanomolar to ten micromolar in the blood are contemplated.

A physician or veterinarian can readily determine and prescribe the "effective amount" of the composition required. For example, the physician or veterinarian could start doses of the compounds employed in the composition at levels lower than that required in order to achieve the desired therapeutic effect and gradually increase the dosage until the desired effect is achieved.

A "therapeutically effective amount" as used herein, is an amount that achieves at least partially a desired therapeutic or prophylactic effect in an organ or tissue. In one example, the amount of a modified DT necessary to bring about prevention and/or therapeutic treatment of the disease is not fixed per se. The amount of modified DT fusion toxin administered may vary with the type of disease, extent of the disease, and size of species of the mammal suffering from the disease. Generally, amounts will be in the range of those used for other cytotoxic agents used in the treatment of cancer, although in certain instances lower amounts will be needed because of the specificity and increased toxicity of the modified DT fusion toxins. By way of example only, exemplary doses of the constructs described herein may be 9 μg/kg/day or 18 μg/kg/day.

In certain circumstances and as can be achieved by, currently available techniques for example (cannulae or convection enhanced delivery, selective release) attempts to deliver enhanced locally elevated fusion toxin amounts to specific sites may also be desired.

One embodiment contemplates the use of the compositions described herein to make a medicament for treating a condition, disease or disorder described herein. Medicaments can be formulated based on the physical characteristics of the patient/subject needing treatment, and can be formulated in single or multiple formulations based on the stage of the condition, disease or disorder. Medicaments can be packaged in a suitable package with appropriate labels for the distribution to hospitals and clinics wherein the label is for the indication of treating a subject having a disease described herein. Medicaments can be packaged as a single or multiple units. Instructions for the dosage and administration of the compositions can be included with the packages as described below.

The invention is further directed to pharmaceutical compositions comprising a modified toxin or fusion protein thereof described hereinabove and a pharmaceutically acceptable carrier.

Sterile injectable solutions can be prepared by incorporating an active ingredient in the required amount in an appropriate solvent with one or a combination of ingredients enumerated above, as required, followed by filtered sterilization. Generally, dispersions are prepared by incorporating the active ingredient into a sterile vehicle which contains a basic dispersion medium and the required other ingredients from those enumerated above. In the case of sterile powders for the preparation of sterile injectable solutions, the preferred methods of preparation are vacuum drying and freeze drying which yields a powder of the active ingredient plus any additional desired ingredient from a previously sterile-filtered solution thereof.

In certain embodiments is the further purification of this mixture to obtain preparations essentially comprising fusion proteins. This purification is accomplished by further chromatographic separation which can be accomplished by affinity chromatography for example, using a salt gradient to elute the various species of immunotoxins and gel filtration to separate the immunotoxins from larger molecules.

A gel to be used in purification of compounds described herein is a three dimensional network which has a random structure. Molecular sieve gels are those cross-linked polymers that do not bind or react with the material being analyzed or separated. For gel filtration purposes, a gel material is generally uncharged. The space within the gel is filled with liquid and the liquid phase constitutes the majority of the gel volume. Materials commonly used in gel filtration columns include dextran, agarose and polyacrylamide.

Dextran is a polysaccharide composed of glucose residues and is commercially available under the name SEPHADEX (Phamacia Fine Chemicals, Inc.). The beads are prepared with various degrees of cross-linking in order to separate different sized molecules by providing various pore sizes. Alkyl dextran is cross-linked with N,N'-methylenebisacrylamide to form SEPHACRYL-S100 to S1000 which allows strong beads to be made that fractionate in larger ranges than SEPHADEX can achieve.

Polyacrylamide can also be used as a gel filtration medium. Polyacrylamide is a polymer of cross-linked acrylamide prepared with N,N'-methylenebisacrylamide as the cross-linking agent. Polyacrylamide is available in a variety of pore sizes from Bio-Rad Laboratories (USA) to be used for separation of different size particles.

The gel material swells in water and in a few organic solvents. Swelling is the process by which the pores become filled with liquid to be used as eluant. As the smaller molecules enter the pores, their progress through the gel is retarded relative to the larger molecules which do not enter the pores, forming the basis of the separation. The beads are available in various degrees of fineness to be used in different applications. The coarser the bead, the faster the flow and the poorer the resolution. Superfine can be used for maximum resolution, but the flow is very slow. Fine is used for preparative work in large columns which require a faster flow rate. The coarser grades are for large preparations in which resolution is less important than time, or for separation of molecules with a large difference in molecular weights.

Affinity chromatography is generally based on the recognition of a protein by a substance such as a ligand or an antibody. The column material can be synthesized by covalently coupling a binding molecule, such as an activated dye, for example to an insoluble matrix. The column material is then allowed to adsorb the desired substance from solution. Next, the conditions are changed to those under which binding does not occur and the substrate is eluted. The requirements for successful affinity chromatography are that the matrix must adsorb molecules, the ligand must be coupled without altering its binding activity, a ligand must be chosen whose binding is sufficiently tight, and it must be possible to elute the substance without destroying it.

One embodiment of the compounds described herein is an affinity chromatography method where the matrix is a reactive dye-agarose matrix. Blue-SEPHAROSE, a column matrix composed of Cibacron Blue 3GA and agarose or SEPHAROSE can be used as the affinity chromatography matrix. Alternatively, SEPHAROSE CL-6B is available as Reactive Blue 2 from Sigma Chemical Company. This matrix binds fusion proteins directly and allows their separation by elution with a salt gradient.

Provided herein are compositions containing modified toxins. In one embodiment, modified toxins comprise diphtheria toxins, said modified diphtheria toxin comprising an amino acid sequence as recited in SEQ ID NO: 2, 148 or 200 with one or more amino acid modifications therein, wherein at least one amino acid modification is made within a T-cell epitope, within an (x)D/E(y) motif in a region selected from among residues 7-9, 29-31 and 290-292 of SEQ ID NO: 2, 148 or 200, within a B-cell epitope, or a combination thereof, and wherein said modified diphtheria toxin has cytotoxicity comparable to an unmodified diphtheria toxin. In one non-limiting example, a modified VLS (x)D/E(y) motif includes a modification at position (x) that is a substitution of V or I by an amino acid residue selected from among A, S, E, F, C, M, T, W, Y, P, H, Q, D, N, K, R, G, L, and a modified or unusual amino acid from Table 1; and wherein a modification at position D/E is a substitution of D or E by an amino acid residue selected from among A, S, E, I, V, L, F, C, M, G, T, W, Y, P, H, Q, N, K, R, and a modified or unusual amino acid from Table 1. In one embodiment, a modification at position (y) is a substitution by I, F, C, M, A, G, T, W, Y, P, H, E, Q, D, N, K, R, S, L, V, and a modified or unusual amino acid from Table 1.

By way of example only, unmodified diphtheria toxins can have, for example, an amino acid sequence of SEQ ID NO: 2, 148 or 200.

Compositions comprising modified diphtheria toxins, said have reduced immunogenicity, reduced binding activity to human vascular endothelial cells (HUVECs), and combinations thereof compared to an unmodified diphtheria toxin. Such compositions can further comprise a non-diphtheria toxin polypeptide including, but not limited to, an antibody or antigen-binding fragment thereof, EGF, IL-1, IL-2, IL-3, IL-4, IL-5, IL-6, IL-7, IL-8, IL-9, IL-10, IL-11, IL-12, IL-13, IL-14, IL-15, INFα, INFγ, GM-CSF, G-CSF, M-CSF, TNF, VEGF, Ephrin, BFGF and TGF. The non-diphtheria toxin polypeptide can also be a fragment of such polypeptides, such as a cell-binding portion thereof. In one embodiment, the non-diphtheria toxin polypeptide is IL-2 or a cell binding portion thereof.

Modified toxins and fusion proteins thereof having reduced immunogenicity, reduced binding to HUVECs, reduced side effects or a combination thereof while maintaining the cytotoxicity can be used for the treatment of various blood cancers (e.g., leukemias), lymphoid-derived malignancies (e.g., cancers), solid tumors and non-malignant diseases such as GVHD or psoriasis.

Cancers

The term "tumor cell antigen" is defined herein as an antigen that is present in higher quantities on a tumor cell or in body fluids than unrelated tumor cells, normal cells, or in normal body fluid. The antigen presence may be tested by any number of assays known to those skilled in the art and include without limitation negative and/or positive selection with antibodies, such as an ELISA assay, a radioimmunoassay, or by Western Blot.

"Apoptosis inducing agent" is defined herein to induce apoptosis/programmed cell death, and include, for example, anticancer agents and treatments wherein cells (e.g., tumor cells) are induced to undergo programmed cell death. Exemplary apoptosis inducing agents are described in more detail below.

The terms "apoptosis" or "programmed cell death," refers to the physiological process by which unwanted or useless cells are eliminated during development and other normal biological processes. Apoptosis is a mode of cell death that occurs under normal physiological conditions and the cell is an active participant in its own demise ("cellular suicide"). It is most often found during normal cell turnover and tissue homeostasis, embryogenesis, induction and maintenance of immune tolerance, development of the nervous system and endocrine-dependent tissue atrophy. Cells undergoing apoptosis show characteristic morphological and biochemical features. These features include chromatin aggregation, nuclear and cytoplasmic condensation, partition of cytoplasm and nucleus into membrane bound vesicles (apoptotic bodies), which contain ribosomes, morphologically intact mitochondria and nuclear material. In vivo, these apoptotic bodies are rapidly recognized and phagocytized by macrophages, dendritic cells or adjacent epithelial cells. Due to this efficient mechanism for the removal of apoptotic cells in vivo no inflammatory response is elicited. In vitro, the apoptotic bodies as well as the remaining cell fragments ultimately swell and finally lyse. This terminal phase of in vitro cell death has been termed "secondary necrosis." Apoptosis can be measured by methods known to those skilled in the art like DNA fragmentation, exposure of Annexin V, activation of caspases, release of cytochrome c, etc. A cell that has been induced to die is termed herein as an "apoptotic cell."

Apoptosis can also be tested using a standard Annexin V Apoptosis Assay: NIH:OVCAR-3 cells are grown in 6-well plates (NUNC) and irradiated or treated with an antagonist (or in combination with another anti-cancer drug) for 4-48 hours, washed and stained with Annexin V-FITC (BD-Pharmingen) for 1 hour. Cells are analyzed by flow cytometry (Becton-Dickinson, CellQuest), counterstained with Propidium Iodide and analyzed again in the flow cytometer.

Patients can be assessed with respect to symptoms at one or more multiple time points including prior to, during, and after treatment regimens. Treatment can result in improving the subject's condition and can be assessed by determining if one or more of the following factors has occurred: decreased tumor size, decreased cell proliferation, decreased numbers of cells, decreased neovascularization, increased apoptosis, or decreased survival of at least a portion of the tumor cells. One or more of these occurrences may, in some cases, result in partial or total elimination of the cancer and prolongation of survival of the patient. Alternatively, for terminal stage cancers, treatment may result in stasis of disease, better quality of life and/or prolongation of survival.

Methods of Assaying Cell Migration

Assays for cell migration have been described in the literature, e.g., by Brooks, et al., J. Clin. Invest 1997, 99:1390-1398 and methods for measuring cell migration are known to those of skill in the art. In one method for measuring cell migration described herein, membranes from transwell migration chambers are coated with substrate, the transwells washed, and non-specific binding sites blocked with BSA. Tumor cells from sub-confluent cultures are harvested, washed, and resuspended in migration buffer in the presence or absence of assay antibodies. After the tumor cells are allowed to migrate to the underside of the coated transwell membranes, the cells remaining on the top-side of the membrane are removed and cells that migrate to the under-side are stained with crystal violet. Cell migration is then quantified by direct cell counts per microscopic field.

Methods of Assaying Tumor Growth

Tumor growth can be assayed by methods known to those of skill in the art, e.g., the SCID mouse model, the nude mouse model, and BALB/c mice with syngeneic tumors. SCID mouse models for tumor growth are carried out as follows: subconfluent human M21 melanoma cells (or any desired tumor cell type) are harvested, washed, and resuspended in sterile PBS ($20\times10^6$ per mL). SCID mice are injected subcutaneously with 100 µL of M21 human melanoma cell ($2\times10^6$) suspension. Three days after tumor cell injection, mice are either untreated or treated intraperitoneally with an antagonist in the desired dose ranges. The mice are treated daily for 24 days. Tumor size is measured with calipers and the volume estimated using the formula $V=(L\times W^2)/2$, where V is equal to the volume, L is equal to the length, and W is equal to the width.

Alternatively, nude mouse models, SCID mouse models and/or BALB/c syngeneic mouse models can also be utilized to assess tumor growth and inhibition thereof by the humanized anti-endoglin antibodies or antigen-binding fragments described herein.

Methods of Assaying Cell Proliferation

Cell proliferation can be assayed by methods known to those of skill in the art. As described herein, subconfluent human endothelial cells (HUVECs) can be resuspended in proliferation buffer containing low (5.0%) serum in the presence or absence of CM (25 µL) from ECV or ECVL cells, and endothelial cells allowed to proliferate for 24 hours. Proliferation can be quantified by measuring mitochondrial dehydrogenase activity using a commercially available WST-1 assay kit (Chemicon). Also, as described herein, proliferation can be quantified by measuring $^3H$ incorporation using standard methods. (She et al., Int. J. Cancer, 108: 251-257 (2004)).

Other methods of assessing cell proliferation are known in the art and are contemplated herein. Further non-limiting examples are described in more detail in the examples.

One would understand that classification and staging systems described herein represent one means to assess treatment of cancers described herein; additionally, other staging schemes are known in the art and may be used in connection with the methods described herein. By way of example only, the TNM classification of malignant tumors may be used as a cancer staging system to describe the extent of cancer in a patient's body. T describes the size of the tumor and whether it has invaded nearby tissue, N describes regional lymph nodes that are involved, and M describes distant metastasis. TNM is maintained by the International Union Against Cancer (UICC) and is used by the American Joint Committee on Cancer (AJCC) and the International Federation of Gynecology and Obstetrics (FIGO). One would understand that not all tumors have TNM classifications such as, for example, brain tumors. Generally, T (a,is,(0), 1-4) is measured as the size or direct extent of the primary tumor. N (0-3) refers to the degree of spread to regional lymph nodes: N0 means that tumor cells are absent from regional lymph nodes, N1 means that tumor cells spread to the closest or small numbers of regional lymph nodes, N2 means that tumor cells spread to an extent between N1 and N3; N3 means that tumor cells spread to most distant or numerous regional lymph nodes. M (0/1) refers to the presence of metastasis: M0 means that no distant metastasis are present; M1 means that metastasis has occurred to distant organs (beyond regional lymph nodes). Other parameters may also be assessed. G (1-4) refers to the grade of cancer cells (i.e., they are low grade if they appear similar to normal cells, and high grade if they appear poorly differentiated). R (0/1/2) refers to the completeness of an operation (i.e., resection-boundaries free of cancer cells or not). L (0/1) refers to invasion into lymphatic vessels. V (0/1) refers to invasion into vein. C (1-4) refers to a modifier of the certainty (quality) of V.

Provided herein are methods for degrading, inhibiting the growth of or killing cancer cells comprising contacting the cells with an amount of a compound described herein effective to degrade, inhibit the growth of or kill cancer cells.

Provided herein are methods of inhibiting tumor size increase, reducing the size of a tumor, reducing tumor proliferation or preventing tumor proliferation in an individual comprising administering to said individual an effective amount of a compound described herein to inhibit tumor size increase, reduce the size of a tumor, reduce tumor proliferation or prevent tumor proliferation. Treatment of tumors in some cases includes stasis of symptoms, that is, by treating the patient, the cancer does not worsen and survival of the patient is prolonged.

Patients may be assessed with respect to symptoms at one or more multiple time points including prior to, during, and after treatment regimens. Treatment can result in improving the subject's condition and can be assessed by determining if one or more of the following events has occurred: decreased tumor size, decreased tumor cell proliferation, decreased numbers of cells, decreased neovascularization and/or increased apoptosis. One or more of these occurrences may, in some cases, result in partial or total elimination of the cancer and prolongation of survival of the patient. Alternatively, for terminal stage cancers, treatment may result in stasis of disease, better quality of life and/or prolongation of survival. Other methods of assessing treatment are known in the art and contemplated herein.

In an exemplary embodiment, the T-cell epitope modified DT fusion toxins of the invention are administered to a subject such as a mammal (e.g., a human), suffering from a medical disorder, e.g., a cancer, or non-malignant conditions characterized by the presence of a class of unwanted cells to which a targeting ligand can selectively bind.

Primary outcome measures may be assessed for patients treated using the methods described herein and include, for example, progression-free survival. In one embodiment, an increase in progression free survival is observed in an amount of by about 2-fold, 5-fold, 10-fold, 20 fold, 50 fold or more compared to lack of treatment. In another embodiment, an increase in progression free survival is increased survival by about 3 months, about 6 months, about 9 months, about 12 months, about 18 months, about 2 years, about 3 years, about 4 years, about 5 years or more compared to lack of treatment.

Secondary outcome measures may also be assessed and include duration of response, time to tumor progression, overall survival, serious and non-serious adverse events. For example, a treatment may prevent progression of the disease (i.e., stasis) or may result in an improvement. Alternately, or in addition, other goals can be measured with respect to one or more of the following: decreased tumor burden, decreased neovascularization, reduced side effects, decreased adverse reactions, and/or increased patient compliance.

Blood Cancers

Blood cancers represent one type of cancer that may be treating using the methods described herein. Blood cancers include, but are not limited to, acute non-lymphocytic leukemias, chronic lymphocytic leukemia, chronic myelogenous leukemia, acute myelogenous leukemia, acute lymphatic leukemia (ALL), chronic lymphatic leukemia (CLL), acute-myeloid leukemia (AML), chronic myeloid leukemia (CML), etc.

Chronic Lymphocytic Leukemia

Chronic lymphocytic leukemia (also known as "chronic lymphoid leukemia" or "CLL"), is a type of leukemia, or cancer of the white blood cells (lymphocytes). CLL affects a particular lymphocyte, the B cell, which originates in the bone marrow, develops in the lymph nodes, and normally fights infection. In CLL, the DNA of a B cell is damaged, so that it can't fight infection, but it grows out of control and crowds out the healthy blood cells that can fight infection. CLL is an abnormal neoplastic proliferation of B cells where cells accumulate mainly in the bone marrow and blood. The World Health Organization considers CLL and small lymphocytic lymphoma (SLL), a type of non-Hodgkin's lymphoma which presents primarily in the lymph nodes to be different stages of the same disease. Most people are diagnosed without symptoms as the result of a routine blood test that returns a high white blood cell count, but as it advances CLL results in swollen lymph nodes, spleen, and liver, and eventually anemia and infections. Early CLL is not treated, and late CLL is currently treated with chemotherapy and monoclonal antibodies.

Provided herein is a method of treating a subject having chronic lymphocytic leukemia by administering a modified DT fusion protein as described herein. In one embodiment, a subject has been previously treated. By way of example only, a modified DT fusion protein as described herein may be administered as a 60-minute intravenous infusion for 5 days every 21 days at a dose of 18 µg/kg/day for up to 8 cycles. Overall, patients may exhibit reduction of peripheral chronic lymphocytic leukemia (CLL) cells, reductions in lymph node size, and in some cases, remission as identified over time from bone marrow biopsies. In one instance, a patient to be treated may be chemorefractory against fludarabine.

Human T-Cell Lymphotrophic Virus 1-Associated Acute T Cell Leukemia/Lymphoma

Provided herein is a method of treating a subject having human T-cell lymphotrophic virus 1-associated acute T cell leukemia/lymphoma by administering a modified DT fusion protein as described herein. By way of example only, 4 cycles of modified DT fusion protein may be administered. A subject may be assessed with respect to restoration of normal hematopiesis and a reduction in bone marrow myelofibrosis. Following disease progression, 4 cycles of hyper-CVAD (hyperfractionated cyclophosphamide/doxorubicin/vincristine/decadron) may be administered until complete clinical remission has been achieved. The patient may receive maintenance therapy for 1 year. In one embodiment, a subject may be further treated with hyper-CVAD therapy.

Acute Myeloid Leukemia

In another aspect, provided herein is a method of treating acute myeloid leukemia (AML), preferably acute promyelocytic leukemia in peripheral blood. AML begins in the bone marrow but can spread to other parts of the body including the lymph nodes, liver, spleen, central nervous system, and testes. It is acute meaning it develops quickly and may be fatal if not treated within a few months. AML is characterized by immature bone marrow cells usually granulocytes or monocytes, which continue to reproduce and accumulate.

There are other types of leukemias that can also be treated by the methods provided herein including but not limited to, Acute Lymphocytic Leukemia, Acute Myeloid Leukemia, Chronic Lymphocytic Leukemia, Chronic Myeloid Leukemia, Hairy Cell Leukemia, Myelodysplasia, and Myeloproliferative Disorders.

The methods provided herein may provide a beneficial effect for leukemia patients, by administration of a modified DT fusion protein or a combination of administration of a modified DT fusion protein and one or more anticancer treatments.

Solid Tumors

Exemplary solid tumors include, but are not limited to, leiomyomas, a brain tumor (e.g., a malignant, pre-malignant or benign brain tumor such as, for example, a glioblastoma, an astrocytoma, a meningioma, a medulloblastoma or a peripheral neuroectodermal tumor), a carcinoma (e.g., gall bladder carcinoma, bronchial carcinoma, basal cell carcinoma, adenocarcinoma, squamous cell carcinoma, small cell carcinoma, large cell undifferentiated carcinoma, adenomas, cystadenoma, etc.), a basalioma, a teratoma, a retinoblastoma, a choroidea melanoma, a seminoma, a sarcoma (e.g., Ewing sarcoma, rhabdomyosarcoma, craniopharyngeoma, osteosarcoma, chondrosarcoma, myosarcoma, liposarcoma, fibrosarcoma, leimyosarcoma, Askin's tumor, lymphosarcoma, neurosarcoma, Kaposi's sarcoma, dermatofibrosarcoma, angiosarcoma, etc.), a plasmocytoma, a head and neck tumor (e.g., oral, laryngeal, nasopharyngeal, esophageal, etc.), a liver tumor, a kidney tumor, a renal cell tumor, a squamous cell carcinoma, a uterine tumor, a bone tumor, a prostate tumor, a breast tumor including, but not limited to a breast tumor that is Her2- and/or ER- and/or PR-, a bladder tumor, a pancreatic tumor, an endometrium tumor, a squamous cell carcinoma, a stomach tumor, gliomas, a colorectal tumor, a testicular tumor, a colon tumor, a rectal tumor, an ovarian tumor, a cervical tumor, an eye tumor, a central nervous system tumor (e.g., primary CNS lymphomas, spinal axis tumors, brain stem gliomas, pituitary adenomas, etc.), a thyroid tumor, a lung tumor (e.g., non-small cell lung cancer (NSCLC) or small cell lung cancer), a lymphoma (e.g., cutaneous T-cell lymphomas (CTCL), non-cutaneous peripheral T-cell lymphomas, lymphomas associated with human T-cell lymphotrophic virus (HTLV) such as adult T-cell leukemia/lymphoma (ATLL), B-cell lymphoma, non-Hodgkin lymphoma, Hodgkin's lymphoma, Burkitt lymphoma, adult T-cell leukemia lymphoma, acute-myeloid leukemia (AML), chronic or hepatocellular carcinoma, etc.), a multiple myeloma, a skin tumor (e.g., basal cell carcinomas, squamous cell carcinomas, melanomas such as malignant melanomas, cutaneous melanomas or intraocular melanomas, Dermatofibrosarcoma protuberans, Merkel cell carcinoma or Kaposi's sarcoma), a gynecologic tumor (e.g., uterine sarcomas, carcinoma of the fallopian tubes, carcinoma of the endometrium, carcinoma of the cervix, carcinoma of the vagina, carcinoma of the vulva, etc.), Hodgkin's disease, a cancer of the small intestine, a cancer of the endocrine system (e.g., a cancer of the thyroid, parathyroid or adrenal glands, etc.), a mesothelioma, a cancer of the urethra, a cancer of the penis, tumors related to Gorlin's syndrome (e.g., medulloblastomas, meningioma, etc.), a tumor of unknown origin; or metastases of any thereto.

Therefore, provided herein is a method of treating a subject having one or more solid tumors by administering a modified DT fusion protein as described herein.

Breast Cancer

In one aspect, provided herein is a method of treating breast cancer, such as a ductal carcinoma in duct tissue in a mammary gland, a breast cancer that is Her2- and/or ER- and/or PR-.

Several types of breast cancer exist that may be treated by the methods described herein. A lobular carcinoma in situ and a ductal carcinoma in situ are breast cancers that have developed in the lobules and ducts, respectively, but have not spread to the fatty tissue surrounding the breast or to other areas of the body. Infiltrating (or invasive) lobular and ductal carcinoma are cancers that have developed in the lobules and ducts, respectively, and have spread to either the breast's fatty tissue and/or other parts of the body. Other cancers of the breast that would benefit from treatment by the methods are medullary carcinomas, colloid carcinomas, tubular carcinomas, and inflammatory breast cancer.

In one embodiment, breast cancer is staged according to the TNM system. Prognosis is closely linked to results of staging, and staging is also used to allocate patients to treatments both in clinical trials and clinical practice.

Briefly, the information for staging is as follows: TX: Primary tumor cannot be assessed. T0: No evidence of tumor. Tis: Carcinoma in situ, no invasion; T1: Tumor is 2 cm or less; T2: Tumor is more than 2 cm but not more than 5 cm; T3: Tumor is more than 5 cm; T4: Tumor of any size growing into the chest wall or skin, or inflammatory breast cancer. NX: Nearby lymph nodes cannot be assessed N0: cancer has not spread to regional lymph nodes. N1: cancer has spread to 1 to 3 axillary or one internal mammary lymph node N2: cancer has spread to 4 to 9 axillary lymph nodes or multiple internal mammary lymph nodes N3: One of the following applies: cancer has spread to 10 or more axillary lymph nodes, or cancer has spread to the lymph nodes under the clavicle (collar bone), or cancer has spread to the lymph nodes above the clavicle, or cancer involves axillary lymph nodes and has enlarged the internal mammary lymph nodes, or cancer involves 4 or more axillary lymph nodes, and tiny amounts of cancer are found in internal mammary lymph nodes on sentinel lymph node biopsy. MX: presence of distant spread (metastasis) cannot be assessed. M0: no distant spread. M1: spread to distant organs (not including the supraclavicular lymph node) has occurred. The methods provided herein may provide a beneficial effect for breast cancer patients, by administration of a modified DT fusion protein or a combination of administration of a modified DT fusion protein and one or more anticancer treatments.

Cutaneous T-Cell Lymphoma

Cutaneous T cell lymphoma (CTCL) is a lymphoma of T cell (a type of white blood cell that is responsible for immune function) origin that affects the skin. Its symptoms vary. Often it is confined to the skin and can be treated and cured. Aggressive forms can extend beyond the skin to the lymph nodes, blood, and internal organs.

WHO-EORTC Classification of Cutaneous T-Cell Lymphoma (CTCL) is typically classified as indolent clinical behavior or aggressive clinical behavior. Indolent Clinical Behavior encompasses, but is not limited to, Mycosis fungoides (MF); Mycosis fungoides variants and subtypes (e.g., Folliculotropic MF, Pagetoid reticulosis, and Granulomatous slack skin); Primary cutaneous CD30+ lymphoproliferative disorder (e.g., Primary cutaneous anaplastic large cell lymphoma and Lymphomatoid papulosis); subcutaneous panniculitis like T-cell lymphoma (provisional); and Primary cutaneous CD4+ small/medium-sized pleomorphic T-cell lymphoma (provisional). Aggressive clinical behavior encompasses, but is not limited to, Sézary syndrome; Adult T-cell leukemia/lymphoma; extranodal NK/T-cell lymphoma, nasal type; Primary cutaneous peripheral T-cell lymphoma, unspecified; Primary cutaneous aggressive epidermotropic CD8+ T-cell lymphoma (provisional); and cutaneous g/d T-cell lymphoma (provisional).

Precursor Hematologic Neoplasm, which is not a T-cell lymphoma, is generally characterized by CD4+/CD56+ hematodermic neoplasm (blastic NK-cell lymphoma).

CTCL staging generally occurs in three parts: (1) early stage: IA: <10% patch/plaque, IB: >10% BSA patch/plaque, and HA: palpable adenopathy; (2) intermediate stage: IIB: Cutaneous tumors (T3), III: Erythroderma (T4), and IVA: Node biopsy positive; and (3) advanced state: visceral involvement (heart, lungs, liver, pancreas or intestines).

By way of example only, the classification of CTCL is as follows: T1: Patches, plaques, or both, involving <10% body surface area, T2: Patches, plaques, or both, involving P10% body surface area, T3: One or more cutaneous tumors, T4: Generalized erythroderma, N0: Lymph nodes clinically uninvolved, N1: Lymph nodes clinically enlarged but not histologically involved, N2: Lymph nodes clinically non-palpable but histologically involved, N3: Lymph nodes clinically enlarged and histologically involved, M0: No visceral metastases, M1: Visceral metastases, B0: No circulating atypical cells (Sezary cells), <5%, and B1: Circulating atypical cells (Sezary cells), ≥5%.

A modified DT fusion protein (conjugate) described herein may be used to prevent, treat, or modulate symptoms associated with cutaneous T-cell lymphoma in a subject. A subject may have been previously treated for cutaneous T-cell lymphoma. Briefly, a conjugate described herein may be administered, for example, intravenously for 3 or 5 consecutive days a dose of 4 µg/kg/day, 9 µg/kg/day or 18 µg/kg/day for 3-21 cycles. An overall response and/or improvement may be observed.

Mycosis Fungoides (MF)

Clinically, Mycosis Fungoides (MF) affects older adults (median age at diagnosis: 55-60 years); characteristically shows a combination of patches, plaques, and tumors, which often show ulceration; and in some patients, lymph nodes and visceral organs may become involved in the later stages of the disease.

Disease is generally confined to the skin; therefore, skin-targeted therapies are generally used and include, for example: Psoralen plus ultraviolet A [PUVA]), topical application of nitrogen mustard or chlormustine (BCNU) and radiotherapy, including total skin electron beam irradiation. Lymph node or systemic involvement, or in cases with widespread tumor-stage MF refractory to skin-targeted therapies: are generally treated with chemotherapy. Newer treatments include, for example: Interferon alpha and other cytokines (e.g., interleukin-12 [IL-12]); new retinoids such as bexarotene; and receptor-targeted cytotoxic fusion proteins (eg, DAB389IL-2; denileukin diftitox/ONTAK®).

Provided herein is a method of treating MF by administering a modified DT toxin fusion protein described herein.

Sezary Syndrome

One example of CTCL with Aggressive Behavior is Sézary Syndrome. Clinically, Sézary Syndrome is found exclusively in adults. Common findings include, but are not limited to: Erythroderma, (which may be associated with marked exfoliation), Edema, Lichenification (which is intensely pruritic), Lymphadenopathy, and Alopecia. Prognosis is as follows: aggressive clinical course with rapid progression, median survival 2-4 years, and most patients die of opportunistic infections that are due to immunosuppression.

Current treatments include: extracorporeal photopheresis alone or in combination with other treatment modalities (e.g. interferon alpha); interferon alpha, either alone or in combination with PUVA therapy; or prolonged treatment with a combination of low-dose chlorambucil with prednisone or methotrexate.

Provided herein is a method of preventing, treating, or modulating the symptoms of Sézary Syndrome in a subject by administering a modified DT fusion protein as described herein. In one embodiment, a subject is further administered extracorporeal photopheresis, extracorporeal photopheresis/interferon alpha, interferon alpha, interferon alpha/PUVA, or low-dose chlorambucil with prednisone or methotrexate.

Relapsed/Refractory T-Cell and B-Cell Non-Hodgkin Lymphoma

Lymphomas are divided into two general types: Hodgkin's lymphoma and non-Hodgkin's lymphoma. Both Hodgkin's lymphoma and non-Hodgkin's lymphoma may occur in AIDS patients, but non-Hodgkin's lymphoma is more common. When a person with AIDS has non-Hodgkin's lymphoma, it is called an AIDS-related lymphoma. Non-Hodgkin's lymphomas may be indolent (slow-growing) or aggressive (fast-growing). AIDS-related lymphoma is usually aggressive. The three main types of AIDS-related lymphoma are diffuse large B-cell lymphoma, B-cell immunoblastic lymphoma and small non-cleaved cell lymphoma.

Treatment of AIDS-related lymphoma combines treatment of the lymphoma with treatment for AIDS. Patients with AIDS have weakened immune systems and treatment can cause further damage. For this reason, patients who have AIDS-related lymphoma are usually treated with lower doses of drugs than lymphoma patients who do not have AIDS. Highly-active antiretroviral therapy (HAART) is used to slow progression of HIV. Medicine to prevent and treat infections, which can be serious, is also used.

Provided herein is a method of preventing, treating, or modulating the symptoms of relapsed/refractory T-cell and B-cell non-Hodgkin lymphoma in a subject by administering a modified DT fusion protein as described herein. By way of example only, eligible subject may be administered a modified DT fusion protein described herein (18 μg/kg/day) for 5 days every three weeks for up to eight cycles. Such a regimen may be well tolerated in subjects and be effective in treating relapsed/refractory T-cell and B-cell non-Hodgkin lymphoma. Furthermore or alternatively, a modified DT fusion protein as described herein may be administered in combination with rituximab to treat patients having relapsed/refractory B-cell non-Hodgkin lymphoma.

Panniculitic T-Cell Lymphoma

Panniculitis is a group of diseases whose hallmark is inflammation of subcutaneous adipose tissue. It can occur in any fatty tissue (cutaneous or visceral) and is often diagnosed on the basis of a deep skin biopsy, and can be further classified by histological characteristics based on the location of the inflammatory cells (within fatty lobules or in the septa which separate them) and on the presence or absence of vasculitis. Symptoms include tender skin nodules, and systemic signs such as weight loss and fatigue. Panniculitis with systemic disease can be caused, for example, by lymphoproliferative diseases such as lymphoma or histiocytosis; by pancreatitis or pancreatic cancer. Subcutaneous panniculitic-like T-cell lymphoma is a rare subtype of primary cutaneous T-cell lymphoma clinically mimicking panniculitis. The clinical course is usually protracted with recurrent cutaneous lesions but rarely with early extracutaneous dissemination.

Provided herein is a method of treating a subject having panniculitic T-cell lymphoma by administering a modified DT fusion protein as described herein. In one aspect, a subject may have been previously treated with bexarotene and interferon alpha and relapsed within 2 months of therapy. By way of example only, a subject may be treated with 1 cycle of intravenous a modified DT fusion protein (9 μg/kg/day for 5 days). Clinical remission may observed with resolution of all cutaneous disease, and constitutional symptoms may be achieved within about 2 weeks or more after the completion of the third cycle of intravenous infusion. In one non-limiting embodiment, if needed, the subject may be treated in combination with one or more other therapies, such as, for example, bexarotene and/or interferon alpha.

Extranodal Natural Killer/T Cell Lymphoma, Nasal Type

Extranodal NK/T-cell lymphoma, nasal type, is a rare disease in the United States, but more prevalent in Asia, Mexico and Central and South America. The most common site is the nasal cavities or paranasal sinuses. Other sites may include skin, gastrointestinal tract, testis, kidney, upper respiratory tract and rarely the eye/orbit. Clinical presentation varies depending on the primary sites of involvement. In some cases, subjects present with a nasal mass with bleeding and local bony destruction. In other more rare cases, subjects may present with skin ulcer or gastrointestinal tract perforation if these sites are primarily involved. About 10-20% of patients presenting with nasal NK/T-cell lymphoma may also have skin involvement at same time.

Although extranodal NK/T-cell lymphoma, nasal type, is found in various places, it often bears very similar histological features throughout. Characteristic features include a prominent but not invariable angiocentric/angiodestructive growth pattern, extensive mucosa ulceration, coagulative necrosis and pseudoepitheliomatous hyperplasia. In some cases, admixed are prominent inflammatory cells including plasma cells, histocytes and often eosinophils. Tumor cells vary greatly in size, but in most cases, they are composed of medium-sized cells or a mixture of small and large cells. They often have granular or vesicular nuclei with irregular nuclear contour and inconspicuous nucleoli and moderate pale to clear cytoplasm. Mitosis is easily found.

The most typical immunophenotype of extranodal NK/T-cell lymphoma is: CD2+, CD56+, surface CD3−, cytoplasmic CD3+, cytotoxic granules such as TIA-1+ and germline T cell receptor (TCR). The expression of CD8 and CD7 is variable. In some cases it may be CD56− and TCR rearranged cytotoxic T-cell lymphoma. EBV positivity is seen in a majority of cases.

The methods provided herein may provide a beneficial effect for extranodal natural killer/T cell lymphoma, nasal type patients, by administration of a modified DT fusion protein or a combination of administration of a modified DT fusion protein and one or more anticancer treatments (e.g., bexarotene, chemotherapy (e.g., CHOP) combined with local radiation, daunorubicin, or L-asparaginase).

Ovarian Cancer

In another aspect, provided herein is a method of treating ovarian cancer, including epithelial ovarian tumors. Preferably, the method treats an ovarian cancer selected from the following: an adenocarcinoma in the ovary and an adenocarcinoma that has migrated from the ovary into the abdominal cavity.

The methods provided herein may provide a beneficial effect for ovarian cancer patients, by administration of a modified DT fusion protein or a combination of administration of a modified DT fusion protein and one or more anticancer treatments.

Cervical Cancer

In another aspect, the method treats cervical cancer, preferably an adenocarcinoma in the cervix epithelial. Two main types of this cancer exist: squamous cell carcinoma and adenocarcinomas. The former constitutes about 80-90% of all cervical cancers and develops where the ectocervix (portion closest to the vagina) and the endocervix (portion closest to the uterus) join. The latter develop in the mucous-producing gland cells of the endocervix. Some cervical cancers have characteristics of both of these and are called adenosquamous carcinomas or mixed carcinomas.

The methods provided herein may provide a beneficial effect for cervical cancer patients, by administration of a modified DT fusion protein or a combination of administration of a modified DT fusion protein and one or more anticancer treatments.

Prostate Cancer

In one other aspect, provided herein is a method to treat prostate cancer, preferably a prostate cancer selected from the following: an adenocarcinoma or an adenocarinoma that has migrated to the bone. Prostate cancer develops in the prostate organ in men, which surrounds the first part of the urethra. The prostate has several cell types but 99% of tumors are adenocarcinomas that develop in the glandular cells responsible for generating seminal fluid.

There are two schemes commonly used to stage prostate cancer. The most common is the TNM system, which evaluates the size of the tumor, the extent of involved lymph nodes, and any metastasis (distant spread). As with many other cancers, these are often grouped into four stages (I-IV). Another scheme, used less commonly, is the Whitmore-Jewett stage.

Briefly, Stage I disease is cancer that is found incidentally in a small part of the sample when prostate tissue was removed for other reasons, such as benign prostatic hypertrophy, and the cells closely resemble normal cells and the gland feels normal to the examining finger. In Stage II more of the prostate is involved and a lump can be felt within the gland. In Stage III, the tumor has spread through the prostatic capsule and the lump can be felt on the surface of the gland. In Stage IV disease, the tumor has invaded nearby structures, or has spread to lymph nodes or other organs. Grading is based on cellular content and tissue architecture from biopsies (Gleason) which provides an estimate of the destructive potential and ultimate prognosis of the disease.

The methods provided herein may provide a beneficial effect for prostate cancer patients, by administration of a modified DT fusion protein or a combination of administration of a modified DT fusion protein and one or more anticancer treatments.

Pancreatic Cancer

In another aspect, provided herein is a method of treating pancreatic cancer, preferably a pancreatic cancer selected from the following: an epitheliod carcinoma in the pancreatic duct tissue and an adenocarcinoma in a pancreatic duct. The most common type of pancreatic cancer is an adenocarcinoma, which occurs in the lining of the pancreatic duct.

The methods provided herein may provide a beneficial effect for pancreatic cancer patients, by administration of a modified DT fusion protein or a combination of administration of a modified DT fusion protein and one or more anticancer treatments.

Bladder Cancer

In another aspect, provided herein is a method of treating bladder cancer, preferably a transitional cell carcinoma in urinary bladder. Bladder cancers are urothelial carcinomas (transitional cell carcinomas) or tumors in the urothelial cells that line the bladder. The remaining cases of bladder cancer are squamous cell carcinomas, adenocarcinomas, and small cell cancers. Several subtypes of urothelial carcinomas exist depending on whether they are noninvasive or invasive and whether they are papillary, or flat. Noninvasive tumors are in the urothelium, the innermost layer of the bladder, while invasive tumors have spread from the urothelium to deeper layers of the bladder's main muscle wall. Invasive papillary urothelial carcinomas are slender finger-like projections that branch into the hollow center of the bladder and also grow outward into the bladder wall. Non-invasive papillary urothelial tumors grow towards the center of the bladder. While a non-invasive, flat urothelial tumor (also called a flat carcinoma in situ) is confined to the layer of cells closest to the inside hollow part of the bladder, an invasive flat urothelial carcinoma invades the deeper layer of the bladder, particularly the muscle layer.

The methods provided herein may provide a beneficial effect for bladder cancer patients, by administration of a modified DT fusion protein or a combination of administration of a modified DT fusion protein and one or more anticancer treatments.

Lung Cancer

In another aspect, provided herein is a method to treat lung cancer. The most common type of lung cancer is non-small cell lung cancer (NSCLC), which accounts for approximately 80-85% of lung cancers and is divided into squamous cell carcinomas, adenocarcinomas, and large cell undifferentiated carcinomas. Small cell lung cancer accounts for 15-20% of lung cancers.

Lung cancer staging is an assessment of the degree of spread of the cancer from its original source. It is an important factor affecting the prognosis and potential treatment of lung cancer. Non-small cell lung carcinoma is staged from IA ("one A"; best prognosis) to IV ("four"; worst prognosis). Small cell lung carcinoma is classified as limited stage if it is confined to one half of the chest and within the scope of a single radiotherapy field; otherwise, it is extensive stage.

Lung cancer may be staged using EUS (endoscopic ultrasound) or TNM. Staging a part of the assessment of patients with non-small cell lung carcinoma. These patients undergo staging as part of the process of considering prognosis and treatment. The AJCC recommends TNM staging followed by further grouping.

Primary tumor (T): TX: The primary tumor cannot be assessed, or there are malignant cells in the sputum or bronchoalveolar lavage but not seen on imaging or bronchoscopy; Tis: Carcinoma in situ. T0: No evidence of primary tumor. T1: Tumor less than 3 cm in its greatest dimension, surrounded by lung or visceral pleura and without bronchoscopic invasion into the main bronchus. T2: A tumor with any of: more than 3 cm in greatest dimension; extending into the main bronchus (but more than 2 cm distal to the carina), and obstructive pneumonitis (but not involving the entire lung). T3: A tumor with any of: invasion of the chest wall, diaphragm, mediastinal pleura, or parietal pericardium; extending into the main bronchus, within 2 cm of the carina, but not involving the carina; and obstructive pneumonitis of the entire lung. T4: A tumor with any of: invasion of the mediastinum, heart, great vessels, trachea, esophagus, vertebra, or carina; separate tumor nodules in the same lobe; and malignant pleural effusion. Lymph nodes (N): NX: Lymph nodes cannot be assessed; N0: No lymph nodes involved; N1: Metastasis to ipsilateral peribronchial or ipsilateral hilar lymph nodes; N2: Metastasis to ipsilateral mediastinal or subcarinal lymph nodes; and N3: Metastasis to any of: ipsilateral supraclavicular lymph nodes; ipsilateral scalene lymph nodes; and contralateral lymph nodes. Distant metastasis (M): MX: Distant metastasis cannot be assessed; M0: No distant metastasis; and M1: Distant metastasis is present.

The methods provided herein may provide a beneficial effect for lung cancer patients, by administration of a modified DT fusion protein or a combination of administration of a modified DT fusion protein and one or more anticancer treatments.

Skin Cancer

In another aspect, provided herein is a method to treat skin cancer. There are several types of cancer that start in the skin. The most common types are basal cell carcinoma and squamous cell carcinoma, which are non-melanoma skin cancers. Actinic keratosis is a skin condition that sometimes develops into squamous cell carcinoma. Non-melanoma skin cancers rarely spread to other parts of the body. Melanoma, the rarest form of skin cancer, is more likely to invade nearby tissues and spread to other parts of the body.

The methods provided herein may provide a beneficial effect for skin cancer patients, by administration of a modified DT fusion protein or a combination of administration of a modified DT fusion protein and one or more anticancer treatments.

Eye Cancer, Retinoblastoma

In another aspect, provided herein is a method to treat eye retinoblastoma. Retinoblastoma is a malignant tumor of the retina. Although retinoblastoma may occur at any age, it most often occurs in younger children, usually before the age of 5 years. The tumor may be in one eye only or in both eyes. Retinoblastoma is usually confined to the eye and does not spread to nearby tissue or other parts of the body.

The methods provided herein may provide a beneficial effect for eye retinoblastoma patients, by administration of a modified DT fusion protein or a combination of administration of a modified DT fusion protein and one or more anticancer treatments.

Eye Cancer, Intraocular Melanoma

In another aspect, provided herein is a method to treat intraocular (eye) melanoma. Intraocular melanoma, a rare cancer, is a disease in which cancer cells are found in the part of the eye called the uvea. The uvea includes the iris, the ciliary body, and the choroid. Intraocular melanoma occurs most often in people who are middle aged.

The methods provided herein may provide a beneficial effect for intraocular melanoma patients, by administration of a modified DT fusion protein or a combination of administration of a modified DT fusion protein and one or more anticancer treatments.

Endometrium Cancer

In another aspect, provided herein is a method to treat endometrium cancer. Endometrial cancer is a cancer that starts in the endometrium, the inner lining of the uterus. Some of the examples of the cancer of uterus and endometrium include, but are not limited to, adenocarcinomas, adenoacanthomas, adenosquamous carcinomas, papillary serous adenocarcinomas, clear cell adenocarcinomas, uterine sarcomas, stromal sarcomas, malignant mixed mesodermal tumors, and leiomyosarcomas.

The methods provided herein may provide a beneficial effect for endometrium cancer patients, by administration of a modified DT fusion protein or a combination of administration of a modified DT fusion protein and one or more anticancer treatments.

Liver Cancer

In another aspect, provided herein is a method to treat primary liver cancer (cancer that begins in the liver). Primary liver cancer can occur in both adults and children.

The methods provided herein may provide a beneficial effect for liver cancer patients, by administration of a modified DT fusion protein or a combination of administration of a modified DT fusion protein and one or more anticancer treatments.

Kidney Cancer

In another aspect, provided herein is a method to treat kidney cancer. Kidney cancer (also called renal cell cancer or renal adenocarcinoma) is a disease in which malignant cells are found in the lining of tubules in the kidney.

The methods provided herein may provide a beneficial effect for kidney cancer patients, by administration of a modified DT fusion protein or a combination of administration of a modified DT fusion protein and one or more anticancer treatments.

Thyroid Cancer

In another aspect, provided herein is a method to treat thyroid cancer. Thyroid cancer is a disease in which cancer (malignant) cells are found in the tissues of the thyroid gland. The four main types of thyroid cancer are papillary, follicular, medullary and anaplastic.

The methods provided herein may provide a beneficial effect for thyroid cancer patients, by administration of a modified DT fusion protein or a combination of administration of a modified DT fusion protein and one or more anticancer treatments.

AIDS Related Cancers

Provided herein are methods to treat AIDS-related cancers including, but not limited to AIDS-related lymphoma and Kaposi's Sarcoma. The methods provided herein may provide a beneficial effect for AIDS-related cancers, by administration of a modified DT fusion protein or a combination of administration of modified DT fusion protein or a combination of administration of a modified DT fusion protein and one or more anticancer treatments.

AIDS-Related Lymphoma

In another aspect, provided herein is a method to treat AIDS-related lymphoma. AIDS-related lymphoma is a disease in which malignant cells form in the lymph system of patients who have acquired immunodeficiency syndrome (AIDS). AIDS is caused by the human immunodeficiency virus (HIV), which attacks and weakens the body's immune system. The immune system is then unable to fight infection and diseases that invade the body. People with HIV disease have an increased risk of developing infections, lymphoma, and other types of cancer. Lymphomas are cancers that affect the white blood cells of the lymph system. Lymphomas are divided into two general types: Hodgkin's lymphoma and non-Hodgkin's lymphoma. Both Hodgkin's lymphoma and non-Hodgkin's lymphoma may occur in AIDS patients, but non-Hodgkin's lymphoma is more common. When a person with AIDS has non-Hodgkin's lymphoma, it is called an AIDS-related lymphoma. Non-Hodgkin's lymphomas may be indolent (slow-growing) or aggressive (fast-growing). AIDS-related lymphoma is usually aggressive. The three main types of AIDS-related lymphoma are diffuse large B-cell lymphoma, B-cell immunoblastic lymphoma and small non-cleaved cell lymphoma.

Treatment of AIDS-related lymphoma combines treatment of the lymphoma with treatment for AIDS. Patients with AIDS have weakened immune systems and treatment can cause further damage. For this reason, patients who have AIDS-related lymphoma are usually treated with lower doses of drugs than lymphoma patients who do not have AIDS. Highly-active antiretroviral therapy (HAART) is used to slow progression of HIV. Medicine to prevent and treat infections, which can be serious, is also used.

Kaposi's Sarcoma

In another aspect, provided herein is a method to treat Kaposi's sarcoma. Kaposi's sarcoma is a disease in which cancer cells are found in the tissues under the skin or mucous membranes that line the mouth, nose, and anus. Classic Kaposi's sarcoma usually occurs in older men of Jewish, Italian, or Mediterranean heritage. This type of Kaposi's sarcoma progresses slowly, sometimes over 10 to 15 years. Kaposi's sarcoma may occur in people who are taking immunosuppressants. Kaposi's sarcoma in patients who have Acquired Immunodeficiency Syndrome (AIDS) is called epidemic Kaposi's sarcoma. Kaposi's sarcoma in people with AIDS usually spreads more quickly than other kinds of Kaposi's sarcoma and often is found in many parts of the body.

The methods provided herein may provide a beneficial effect for Kaposi's sarcoma, by administration of a modified DT fusion protein or a combination of administration of a modified DT fusion protein and one or more anticancer treatments.

Viral-Induced Cancers

In another aspect, provided herein is a method to treat viral-induced cancers. Several common viruses are clearly or probable causal factors in the etiology of specific malignancies. These viruses either normally establish latency or few can become persistent infections. Oncogenesis is probably linked to an enhanced level of viral activation in the infected host, reflecting heavy viral dose or compromised immune control. The major virus-malignancy systems include hepatitis B virus (HBV), hepatitis C virus (HCV), and hepatocellular carcinoma; human lymphotropic virus-type 1 (HTLV-1) and adult T-cell leukemia/lymphoma; and human papilloma virus (HPV) and cervical cancer. In general, these malignancies occur relatively early in life, typically peaking in middle-age or earlier.

Virus-Induced Hepatocellular Carcinoma

The causal relationship between both HBV and HCV and hepatocellular carcinoma or liver cancer is established through substantial epidemiologic evidence. Both appear to act via chronic replication in the liver by causing cell death and subsequent regeneration.

Viral-Induced Adult T Cell Leukemia/Lymphoma

The association between HTLV-1 and Adult T cell leukemia (ATL) is firmly established. Unlike the other oncogenic viruses found throughout the world, HTLV-1 is highly geographically restricted, being found primarily in southern Japan, the Caribbean, west and central Africa, and the South Pacific islands. Evidence for causality includes the monoclonal integration of viral genome in almost all cases of ATL in carriers. The risk factors for HTLV-1-associated malignancy appear to be perinatal infection, high viral load, and being male sex. Adult T cell leukemia is a cancer of the blood and bone marrow.

Viral-Induced Cervical Cancer

Infection of the cervix with human papillomavirus (HPV) is the most common cause of cervical cancer. Not all women with HPV infection, however, will develop cervical cancer. Cervical cancer usually develops slowly over time. Before cancer appears in the cervix, the cells of the cervix go through changes known as dysplasia, in which cells that are not normal begin to appear in the cervical tissue. Later, cancer cells start to grow and spread more deeply into the cervix and to surrounding areas.

The methods provided herein may provide a beneficial effect for virally induced cancers, by administration of a modified DT fusion protein or a combination of administration of a modified DT fusion protein and one or more anticancer treatments.

Central Nervous System (CNS) Cancers

Brain and spinal cord tumors are abnormal growths of tissue found inside the skull or the bony spinal column, which are the primary components of the central nervous system (CNS). Benign tumors are non-cancerous, and malignant tumors are cancerous. The CNS is housed within rigid, bony quarters (i.e., the skull and spinal column), so any abnormal growth, whether benign or malignant, can place pressure on sensitive tissues and impair function. Tumors that originate in the brain or spinal cord are called primary tumors. Most primary tumors are caused by out-of-control growth among cells that surround and support neurons. In a small number of individuals, primary tumors may result from specific genetic disease (e.g., neurofibromatosis, tuberous sclerosis) or from exposure to radiation or cancer-causing chemicals. The cause of most primary tumors remains a mystery.

The first test to diagnose brain and spinal column tumors is a neurological examination. Special imaging techniques (computed tomography, and magnetic resonance imaging, positron emission tomography) are also employed. Laboratory tests include the EEG and the spinal tap. A biopsy, a surgical procedure in which a sample of tissue is taken from a suspected tumor, helps doctors diagnose the type of tumor.

Tumors are classified according to the kind of cell from which the tumor seems to originate. The most common primary brain tumor in adults comes from cells in the brain called astrocytes that make up the blood-brain barrier and contribute to the nutrition of the central nervous system. These tumors are called gliomas (astrocytoma, anaplastic astrocytoma, or glioblastoma multiforme) and account for 65% of all primary central nervous system tumors. Some of the tumors are, but not limited to, Oligodendroglioma, Ependymoma, Meningioma, Lymphoma, Schwannoma, and Medulloblastoma.

Neuroepithelial Tumors of the CNS

Astrocytic tumors, such as astrocytoma; anaplastic (malignant) astrocytoma, such as hemispheric, diencephalic, optic, brain stem, cerebellar; glioblastoma multiforme; pilocytic astrocytoma, such as hemispheric, diencephalic, optic, brain stem, cerebellar; subependymal giant cell astrocytoma; and pleomorphic xanthoastrocytoma. Oligodendroglial tumors, such as oligodendroglioma; and anaplastic (malignant) oligodendroglioma. Ependymal cell tumors, such as ependymoma; anaplastic ependymoma; myxopapillary ependymoma; and subependymoma. Mixed gliomas, such as mixed oligoastrocytoma; anaplastic (malignant) oligoastrocytoma; and others (e.g., ependymo-astrocytomas). Neuroepithelial tumors of uncertain origin, such as polar spongioblastoma; astroblastoma; and gliomatosis cerebri. Tumors of the choroid plexus, such as choroid plexus papilloma; and choroid plexus carcinoma (anaplastic choroid plexus papilloma). Neuronal and mixed neuronal-glial tumors, such as gangliocytoma; dysplastic gangliocytoma of cerebellum (Lhermitte-Duclos); ganglioglioma; anaplastic (malignant) ganglioglioma; desmoplastic infantile ganglioglioma, such as desmoplastic infantile astrocytoma; central neurocytoma; dysembryoplastic neuroepithelial tumor; olfactory neuroblastoma (esthesioneuroblastoma. Pineal Parenchyma Tumors, such as pineocytoma; pineoblastoma; and mixed pineocytoma/pineoblastoma. Tumors with neuroblastic or glioblastic elements (embryonal tumors), such as medulloepithelioma; primitive neuroectodermal tumors with multipotent differentiation, such as medulloblastoma; cerebral primitive neuroectodermal tumor; neuroblastoma; retinoblastoma; and ependymoblastoma.

Other CNS Neoplasms

Tumors of the Sellar Region, such as pituitary adenoma; pituitary carcinoma; and craniopharyngioma. Hematopoietic tumors, such as primary malignant lymphomas; plasmacytoma; and granulocytic sarcoma. Germ Cell Tumors, such as germinoma; embryonal carcinoma; yolk sac tumor (endodermal sinus tumor); choriocarcinoma; teratoma; and mixed germ cell tumors. Tumors of the Meninges, such as meningioma; atypical meningioma; and anaplastic (malignant) meningioma. Non-menigothelial tumors of the meninges, such as Benign Mesenchymal; Malignant Mesenchymal; Primary Melanocytic Lesions; Hemopoietic Neoplasms; and Tumors of Uncertain Histogenesis, such as hemangioblastoma (capillary hemangioblastoma). Tumors of Cranial and Spinal Nerves, such as schwannoma (neurinoma, neurilemoma); neurofibroma; malignant peripheral nerve sheath tumor (malignant schwannoma), such as epithelioid, divergent mesenchymal or epithelial differentiation, and melanotic. Local Extensions from Regional Tumors; such as paraganglioma (chemodectoma); chordoma; chodroma; chondrosarcoma; and carcinoma. Metastatic tumors, Unclassified Tumors and Cysts and Tumor-like Lesions, such as Rathke cleft cyst; Epidermoid; dermoid; colloid cyst of the third ventricle; enterogenous cyst; neuroglial cyst; granular cell tumor (choristoma, pituicytoma); hypothalamic neuronal hamartoma; nasal glial herterotopia; and plasma cell granuloma.

The methods provided herein may provide a beneficial effect for CNS neoplasms, by administration of a modified DT fusion protein or a combination of administration of a modified DT fusion protein and one or more anticancer treatments.

Peripheral Nervous System (PNS) Cancers

The peripheral nervous system consists of the nerves that branch out from the brain and spinal cord. These nerves form the communication network between the CNS and the body parts. The peripheral nervous system is further subdivided into the somatic nervous system and the autonomic nervous system. The somatic nervous system consists of nerves that go to the skin and muscles and is involved in conscious activities. The autonomic nervous system consists of nerves that connect the CNS to the visceral organs such as the heart, stomach, and intestines. It mediates unconscious activities.

Acoustic neuromas are benign fibrous growths that arise from the balance nerve, also called the eighth cranial nerve or vestibulocochlear nerve. These tumors are non-malignant, meaning that they do not spread or metastasize to other parts of the body. The location of these tumors is deep inside the skull, adjacent to vital brain centers in the brain stem. As the tumors enlarge, they involve surrounding structures which have to do with vital functions. In the majority of cases, these tumors grow slowly over a period of years.

The malignant peripheral nerve sheath tumor (MPNST) is the malignant counterpart to benign soft tissue tumors such as neurofibromas and schwannomas. It is most common in the deep soft tissue, usually in close proximity of a nerve trunk. The most common sites include the sciatic nerve, brachial plexus, and sarcal plexus. The most common symptom is pain which usually prompts a biopsy. It is a rare, aggressive, and lethal orbital neoplasm that usually arises from sensory branches of the trigeminal nerve in adults. Malignant PNS tumor spreads along nerves to involve the brain, and most patients die within 5 years of clinical diagnosis. The MPNST may be classified into three major categories with epithelioid, mesenchymal or glandular characteristics. Some of the MPNST include but not limited to, Subcutaneous malignant epithelioid schwannoma with cartilaginous differentiation, Glandular malignant schwannoma, Malignant peripheral nerve sheath tumor with perineurial differentiation, Cutaneous epithelioid malignant nerve sheath tumor with rhabdoid features, Superficial epithelioid MPNST, Triton Tumor (MPNST with rhabdomyoblastic differentiation), Schwannoma with rhabdomyoblastic differentiation. Rare MPNST cases contain multiple sarcomatous tissue types, especially osteosarcoma, chondrosarcoma and angiosarcoma. These have sometimes been indistinguishable from the malignant mesenchymoma of soft tissue.

Other types of PNS cancers include but not limited to, malignant fibrous cytoma, malignant fibrous histiocytoma, malignant meningioma, malignant mesothelioma, and malignant mixed Müfterian tumor.

The methods provided herein may provide a beneficial effect for PNS cancers, by administration of a modified DT fusion protein or a combination of administration of a modified DT fusion protein and one or more anticancer treatments.

Oral Cavity and Oropharyngeal Cancer

Management of patients with central nervous system (CNS) cancers remains a formidable task. Cancers such as, hypopharyngeal cancer, laryngeal cancer, nasopharyngeal cancer, oropharyngeal cancer, may be treated using the compounds described herein.

The methods provided herein may provide a beneficial effect for oral cavity and oropharyngeal cancer, by administration of a modified DT fusion protein or a combination of administration of a modified DT fusion protein and one or more anticancer treatments Stomach Cancer Stomach cancer is the result of cell changes in the lining of the stomach. There are three main types of stomach cancers: lymphomas, gastric stromal tumors, and carcinoid tumors. Lymphomas are cancers of the immune system tissue that are sometimes found in the wall of the stomach. Gastric stromal tumors develop from the tissue of the stomach wall. Carcinoid tumors are tumors of hormone-producing cells of the stomach. The causes of stomach cancer continue to be debated. A combination of heredity and environment (diet, smoking, etc) are all thought to play a part.

The methods provided herein may provide a beneficial effect for stomach cancer, by administration of a modified DT fusion protein or a combination of administration of a modified DT fusion protein and one or more anticancer treatments.

Testicular Cancer

Testicular cancer is cancer that typically develops in one or both testicles in young men. Cancers of the testicle develop in certain cells known as germ cells. The 2 main types of germ cell tumors (GCTs) that occur in men are seminomas (60%) and nonseminomas (40%). Tumors can also arise in the supportive and hormone-producing tissues, or stroma, of the testicles. Such tumors are known as gonadal stromal tumors. The 2 main types are Leydig cell tumors and Sertoli cell tumors. Secondary testicular tumors are those that start in another organ and then spread to the testicle. Lymphoma is the most common secondary testicular cancer.

The methods provided herein may provide a beneficial effect for testicular cancer, by administration of a modified DT fusion protein or a combination of administration of a modified DT fusion protein and one or more anticancer treatments.

Thymus Cancer

The thymus is a small organ located in the upper/front portion of your chest, extending from the base of the throat to the front of the heart. The thymus contains 2 main types of cells, thymic epithelial cells and lymphocytes. Thymic epithelial cells can give origin to thymomas and thymic carcinomas. Lymphocytes, whether in the thymus or in the lymph nodes, can become malignant and develop into cancers called Hodgkin disease and non-Hodgkin lymphomas. The thymus also contains another much less common type of cells called Kulchitsky cells, or neuroendocrine cells, which normally release certain hormones. These cells can give rise to cancers, called carcinoids or carcinoid tumors that often release the same type of hormones, and are similar to other tumors arising from neuroendocrine cells elsewhere in the body.

The methods provided herein may provide a beneficial effect for thymus cancer, by administration of a modified DT fusion protein or a combination of administration of a modified DT fusion protein and one or more anticancer treatments.

Colon Cancer and Colorectal Cancer

Colorectal cancer, also called colon cancer or large bowel cancer, includes cancerous growths in the colon, rectum and appendix. With 655,000 deaths worldwide per year, it is the third most common form of cancer and the second leading cause of cancer-related death in the Western world. Many colorectal cancers are thought to arise from adenomatous polyps in the colon. These mushroom-like growths are usually benign, but some may develop into cancer over time.

In another embodiment, Dukes classification may be used to classify colorectal cancer based on stages A-D. Stage A refers to colorectal cancer that is limited to mucosa (i.e., has not invaded through the bowel wall). Stage B1 refers to extending into muscularis propria, but not penetrating through it (i.e., lymph nodes have not been invaded); whereas Stage B2 cancer has penetrated through the muscularis propria, but not penetrating through it (i.e., lymph nodes have not been invaded). Stage C1 refers to cancer that extends into the muscularis propria, but not penetrating through it (i.e., lymph nodes are involved); whereas Stage C2 refers to cancer that extends into the muscularis propria and penetrating through it (i.e., lymph nodes are involved). Stage D refers to distant metastatic spread. The TNM system may also be used to stage colorectal cancer according to conventional means known in the art.

The methods provided herein may provide a beneficial effect for colorectal cancer, by administration of a modified DT fusion protein or a combination of administration of a modified DT fusion protein and one or more anticancer treatments.

Acute Graft-Versus Host Disease

Acute Graft-versus Host Disease (aGVHD) is mediated partly through activated T cells which express the high affinity receptor for IL-2. The acute or fulminant form of the disease (aGVHD) is normally observed within the first 100 days post-transplant, and is a major challenge to transplants owing to associated morbidity and mortality.

Classically, acute graft-versus-host-disease is characterized by selective damage to the liver, skin and mucosa, and the gastrointestinal tract. Newer research indicates that other graft-versus-host-disease target organs include the immune system (the hematopoietic system—e.g. the bone marrow and the thymus) itself, and the lungs in the form of idiopathic pneumonitis.

Acute GVHD of the gastrointestinal tract can result in severe intestinal inflammation, sloughing of the mucosal membrane, severe diarrhea, abdominal pain, nausea, and vomiting. Skin GVHD results in a diffuse maculopapular rash, sometimes in a lacy pattern.

Acute GVHD is staged as follows: overall grade (skin-liver-gut) with each organ staged individually from a low of 1 to a high of 4. Patients with grade IV GVHD usually have a poor prognosis. If the GVHD is severe and requires intense immunosuppression involving steroids and additional agents to get under control, the patient may develop severe Provided herein is a method of treating a subject having aGVHD by administering a modified DT fusion protein described herein. By way of example only, subjects suffering from steroid-resistant aGVHD may be administered, a dose regimen of 4.5 µg/kg daily on days 1-5 and then weekly on study days 8, 15, 22 and 29. Alternatively, subjects may be administered with a dose regimen of 9 µg/kg on the same schedule. Responses may be assessed at days 36 and 100. Subjects may be assessed with respect to one or more symptoms such as, for example, intestinal inflammation, sloughing of the mucosal membrane, severe diarrhea, abdominal pain, nausea, vomiting and/or maculopapular rash. Treatment includes stasis or improvement of symptoms compared to lack of treatment.

Psoriasis

Psoriasis is an immune-mediated skin disease in which T-cells are chronically stimulated by antigen-presenting cells in the skin. Psoriasis is a chronic relapsing disease that requires intermittent treatment. Psoriasis is a non-contagious disorder which affects the skin and joints. The scaly patches caused by psoriasis, called psoriatic plaques, are areas of inflammation and excessive skin production. Skin rapidly accumulates at these sites and takes on a silvery-white appearance. Plaques frequently occur on the skin of the elbows and knees, but can affect any area including the scalp and genitals. The disorder is a chronic recurring condition which varies in severity from minor localized patches to complete body coverage. Fingernails and toenails are frequently affected (psoriatic nail dystrophy)—and can be seen as an isolated finding. Psoriasis can also cause inflammation of the joints, which is known as psoriatic arthritis.

The symptoms of psoriasis can manifest in a variety of forms. Plaque psoriasis (psoriasis vulgaris) is the most common form of psoriasis. It affects 80 to 90% of people with psoriasis. Plaque psoriasis typically appears as raised areas of inflamed skin covered with silvery white scaly skin. These areas are called plaques.

Flexural psoriasis (inverse psoriasis) appears as smooth inflamed patches of skin. It occurs in skin folds, particularly around the genitals (between the thigh and groin), the armpits, under an overweight stomach (pannus), and under the breasts (inframammary fold). It is aggravated by friction and sweat, and is vulnerable to fungal infections.

Guttate psoriasis is characterized by numerous small round spots (differential diagnosis—pityriasis rosea—oval shape lesion). These numerous spots of psoriasis appear over large areas of the body, such as the trunk, limbs, and scalp. Guttate psoriasis is associated with streptococcal throat infection.

Pustular psoriasis appears as raised bumps that are filled with non-infectious pus (pustules). The skin under and surrounding pustules is red and tender. Pustular psoriasis can be localised, commonly to the hands and feet (palmoplantar pustulosis), or generalised with widespread patches occurring randomly on any part of the body.

Nail psoriasis produces a variety of changes in the appearance of finger and toe nails. These changes include discoloring under the nail plate, pitting of the nails, lines going across the nails, thickening of the skin under the nail, and the loosening (onycholysis) and crumbling of the nail.

Psoriatic arthritis involves joint and connective tissue inflammation. Psoriatic arthritis can affect any joint but is most common in the joints of the fingers and toes. This can result in a sausage-shaped swelling of the fingers and toes known as dactylitis. Psoriatic arthritis can also affect the hips, knees and spine (spondylitis).

Erythrodermic psoriasis involves the widespread inflammation and exfoliation of the skin over most of the body surface. It may be accompanied by severe itching, swelling and pain. It is often the result of an exacerbation of unstable plaque psoriasis, particularly following the abrupt withdrawal of systemic treatment. This form of psoriasis can be fatal, as the extreme inflammation and exfoliation disrupt the body's ability to regulate temperature and for the skin to perform barrier functions.

Psoriasis is usually graded as mild (affecting less than 3% of the body), moderate (affecting 3-10% of the body) or severe. Several scales exist for measuring the severity of psoriasis. The degree of severity is generally based on the following factors: the proportion of body surface area affected; disease activity (degree of plaque redness, thickness and scaling); response to previous therapies; and the impact of the disease on the person. The Psoriasis Area Severity Index (PASI) is the most widely used measurement tool for psoriasis. PASI combines the assessment of the severity of lesions and the area affected into a single score in the range 0 (no disease) to 72 (maximal disease).

The modified DT fusion proteins described herein may be administered to effectively target activated T cells and improve psoriasis. By way of example only, patients suffering from severe psoriasis may be treated with one of three doses of a modified DT fusion protein described herein (0.5, 1.5 or 5 µg/kg/day) and receive three doses per week for eight weeks. Patients may be assessed for symptoms as measured by the Psoriasis Area and Severity Index (PASI) and Physician's Global Assessment (PGA). In another embodiment, a subject having psoriasis may be further administered medicated ointments or creams that are applied to the skin, ultraviolet (UV) radiation (phototherapy), and/or systemic treatment.

Other Uses

Also contemplated herein is a method of providing maintenance therapy by administering a non-immunogenic DT fusion protein described herein.

Immunization with RNA-transfected dendritic cells (DCs) is an effective strategy to stimulate potent T cell responses in patients with metastatic cancers. CD4+ T cells constitutively expressing the IL-2 receptor α-chain (CD25) act in a regulatory capacity by suppressing the activation and function, of other T cells. Their physiological role is to protect the host against the development of autoimmunity by regulating immune responses against antigens expressed by normal tissues. CD4+CD25+FOXP3+ regulatory T cells (CD4+ Treg cells) are thought to differentiate in the thymus and immigrate from the thymus to the periphery. Treg cells can regulate both acquired and innate immunity through multiple modes of suppression. Treg cells play a central role in the immunopathogenesis of autoimmune diseases, tumors, and organ transplantation. Since tumor antigens are largely self antigens, T regulatory cells (Tregs) may also prevent the tumor-bearing host from mounting an effective anti-tumor immune response. Previous studies have shown that elevated numbers of CD4+CD25+ Tregs can be found in advanced cancer patients and that high Treg frequencies are associated with reduced survival. Furthermore, transient T cell depletion has been observed to cause regression of melanoma metastasis. The important role of CD4+CD25+ Tregs in controlling tumor growth was further highlighted by the demonstration that depletion of Tregs using anti-CD25 antibodies can evoke effective anti-tumor immunity in mice. Moreover, anti-CD25 therapy enhanced the therapeutic efficacy of GM-CSF-secreting B16 tumor cells and prolonged survival of tumor-bearing animals. Cumulatively, these experimental data suggest that the efficacy of cancer treatment could be enhanced by administration of agents that lead to the preferential depletion of CD4+CD25+ Tregs, such as compounds that target cells expressing the IL-2 receptor CD25 subunit.

Recombinant IL-2 diphtheria toxin conjugate DAB389IL-2 (also known as denileukin diftitox and ONTAK®) to eliminate CD25-expressing Tregs in metastatic renal cell carcinoma (RCC) patients. The cytotoxic action of DAB389IL-2 occurs as a result of binding to the high-affinity IL-2 receptor, subsequent internalization, and enzymatic inhibition of protein synthesis, ultimately leading to cell death.

DAB389IL-2 was shown to selectively eliminate Tregs from human PBMCs in a dose-dependent manner without apparent bystander toxicity to other PBMCs or CD4+ T cells with intermediate- or low-level expression of CD25. Treg depletion resulted in enhanced stimulation of proliferative and cytotoxic T cell responses in vitro but only when DAB389IL-2 was used prior to and omitted during the T cell priming phase. Depletion of Tregs in RCC patients with DAB389IL-2 followed by immunization with tumor RNA-transfected DCs led to improved stimulation of tumor-specific T cells when compared with administration of tumor RNA-transfected DCs alone. CD4+CD25high Tregs can be eliminated using a single dose of DAB389IL-2 without apparent bystander toxicity and without having an impact on the function of other cells expressing CD25. DAB389IL-2 profoundly reduced the number of Tregs present in the peripheral blood of RCC patients, reduced levels of peripheral blood-derived FoxP3 transcripts, and abrogated Treg-mediated immunosuppressive activity in vivo. Moreover, significantly higher frequencies of tumor-specific CD8+ T cells could be measured in patients treated with combined DAB389IL-2 and DC immunization when compared with subjects receiving the DCs alone. Also, there was a trend toward an improved CD4+ T cell response after combined therapy.

Cognate immunity against neoplastic cells depends on a balance between effector T cells and regulatory T (Treg)

cells. Treg cells prevent immune attack against normal and neoplastic cells by directly suppressing the activation of effector CD4+ and CD8+ T cells. The use of a recombinant interleukin 2/diphtheria toxin conjugate (DAB/IL2; Denileukin Diftitox; ONTAK®) was studied as a strategy to deplete Treg cells and break tolerance against neoplastic tumors in humans. DAB/IL2 (12 microg/kg; four daily doses; 21 day cycles) was administered to 16 patients with metastatic melanoma and the effects on the peripheral blood concentration of several T cell subsets and on tumor burden are measured.

DAB/IL2 has been shown to cause a transient depletion of Treg cells as well as total CD4+ and CD8+ T cells (<21 days). T cell repopulation coincided with the de novo appearance of melanoma antigen-specific CD8+ T cells in several patients as determined by flow cytometry using tetrameric MART-1, tyrosinase and gp100 peptide/MHC conjugates. Sixteen patients received at least one cycle of DAB/IL2 and five of these patients experienced regressions of melanoma metastases as measured by CT and/or PET imaging. One patient experienced a near complete response with the regression of several hepatic and pulmonary metastases coupled to the de novo appearance of MART-1-specific CD8+ T cells. A single metastatic tumor remained in this patient and, after surgical resection, immunohistochemical analysis revealed MART1+ melanoma cells surrounded by CD8+ T cells. The transient depletion of T cells in cancer patients may disrupt the homeostatic control of cognate immunity and allow for the expansion of effector T cells with specificity against neoplastic cells.

Lack of naturally induced tumor associated antigen (TAA)-specific immunity is not simply a passive process. Tumors actively prevent induction of TAA-specific immunity through induction of TAA-specific tolerance. This tolerance was mediated in part by regulatory T cells (Tregs). Barnett et al. presented evidence that depleting Tregs in human cancer, including ovarian cancer, using denileukin diftitox (ONTAK®), improves immunity.

CD4+CD25+Foxp3+ regulatory T (Treg) cells have been implicated in the lack of effective antitumor immunity. Denileukin diftitox (DAB(389)IL-2), provides a means of targeting Treg cells. Treg cells in spleen, peripheral blood, and bone marrow of normal C57BL/6 mice were variously reduced after a single intraperitoneal injection of denileukin diftitox; the reduction was evident within 24 hours and lasted approximately 10 days. Injection of denileukin diftitox 1 day before immunization with another agent enhanced antigen-specific T-cell responses above levels induced by immunization alone. In a murine model, the differential effects of denileukin diftitox on Treg cells in different cellular compartments, the advantage of combining denileukin diftitox with another agent to enhance antigen-specific T-cell immune responses, the lack of inhibition by denileukin diftitox of host immune responses directed against a live viral vector, and the importance of dose scheduling of denileukin diftitox when used in combination with an immunogen.

Tregs have been shown to be an integral part of regulating and even suppressing an immune response to growing tumor cells. Three methods of Treg depletion and/or elimination, utilizing low dose cyclophosphamide (CY), a specific antibody directed against the IL-2 receptor found on Tregs (PC61) and the use of denileukin diftitox (DD) have been compared. Utilization of DD resulted in a >50% Treg cell reduction without parallel cytocidal effects upon other T cell subsets but did not enhance anti-tumor immunity against B16 melanoma. Lastly, the PC61 showed a moderate reduction of Tregs that lasted longer than the other reagents, without a reduction in the total number of CD8(+) T cells.

Provided herein is a method for inducing regression of melanoma metastasis in a patient by administering a DT variant-IL2 fusion protein described herein. CD4+CD25+Foxp3+ regulatory T (Treg) cells may be depleted by administering the constructs described herein. In one embodiment, a DT variant-IL2 fusion protein is administered followed by administration of an anti-cancer agent. In one non-limiting example, a DT variant-IL2 fusion protein is administered prior to or subsequent to the anti-cancer agent.

Provided herein is a method of enhancing activity of an anti-cancer agent (e.g., RNA transfected DCs, anti-CLTA4 antibodies, MISIIR scFvs, etc.), by administering a DT variant-IL2 fusion protein described herein. In one embodiment, a DT variant-IL2 fusion protein is administered followed by administration of the anti-cancer agent. In one non-limiting example, a DT variant-IL2 fusion protein is administered at least four (4) days prior to the anti-cancer agent.

Also provided herein is a method of treating a metastatic cancer via reduction or elimination of Tregs by administering an anti-cancer agent (e.g., RNA transfected DCs, anti-CLTA4 antibodies, MISIIR scFvs, etc.) and a DT variant-IL2 fusion protein described herein. Metastatic tumors include, for example, metastatic renal cell carcinoma, metastatic prostate cancer, metastatic ovarian cancer and metastatic lung cancer. In one embodiment, a DT variant-IL2 fusion protein is administered followed by administration of the anti-cancer agent. In one non-limiting example, the DT variant-IL2 fusion protein is administered at least four (4) days prior to the anti-cancer agent.

In another aspect, provided herein is a method of treating a prostate tumor, an ovarian tumor, a lung tumor or a melanoma via reduction or elimination of Tregs by administering an anti-cancer agent (e.g., RNA transfected DCs, anti-CLTA4 antibodies, MISIIR scFvs, etc.) and a DT variant-IL2 fusion protein described herein. In one embodiment, a DT variant-IL2 fusion protein is administered followed by administration of the anti-cancer agent. In one non-limiting example, the DT variant-IL2 fusion protein is administered at least four (4) days prior to the anti-cancer agent.

Toxicity and therapeutic efficacy of such ingredients can be determined by standard pharmaceutical procedures in cell cultures or experimental animals, e.g., for determining the LD50 (the dose lethal to 50% of the population), LC50 (the concentration lethal to 50% of a population) the ED50 (the dose therapeutically effective in 50% of the population) and EC50 (the concentration therapeutically effective to 50% of a population). The dose ratio between toxic and therapeutic effects is the therapeutic index and it can be expressed as the ratio LD50/ED50 or LC50/EC50. Compounds which exhibit large therapeutic indices are preferred. While compounds that exhibit toxic side effects may be used, care should be taken to design a delivery system that targets such compounds to the site of affected tissue in order to minimize potential damage to non-cancerous and otherwise healthy cells and, thereby, reduce side effects.

The data obtained from the cell culture assays and animal studies can be used in formulating a range of dosage for use in humans. The dosage of such compounds lies preferably within a range of circulating concentrations that include the ED50 or EC50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture and as presented below in Example 4. Such information can be used to more accurately determine useful doses in humans. Levels in plasma may be measured, for example, by high performance liquid chromatography.

The embodiments of the compounds and methods of the present application are intended to be illustrative and not limiting. Modifications and variations can be made by persons skilled in the art in light of the above teachings specifically those that may pertain to alterations in the DT toxophore surrounding the described modifications to T-cell epitope sequences, described VLS sequences, and B-cell epitope sequences that could result in reduced immunogenicity, and/or reduced HUVEC binding while maintaining near native functionally with respect to the ability to use as a DT toxophore in protein fusion toxin constructs.

It is also conceivable to one skilled in the art that the compounds and methods described herein can be used for other purposes, including, for example, the delivery of other novel molecules to a selected cell population.

The present application contemplates compositions for use in immunization embodiments. It is contemplated that proteinaceous compositions that are less effective in promoting VLS or other toxic effects by alterations in one or more (x)D/E(y), (x)D/E(y)T and/or flanking sequences are useful as antigens to stimulate an immune response to the toxin. In particular embodiments, DT comprising one or more modified (x)D/E(y), (x)D/E(y)T and/or flanking sequences are contemplated as useful antigens. Preferably the composition is extensively dialyzed to remove undesired small molecular weight molecules and/or lyophilized for more ready formulation into a desired vehicle. In other embodiments, it is also possible to use toxins lacking one or more active site residues (i.e., a toxoid) for immunization.

The compounds and methods described herein can be employed under those circumstances in which amounts of a toxin would be used to deliver such agents in a clinical setting or in settings where it would be desirable to reduce as much as possible the potential for immunogenicity, VLS, or combinations thereof. In this setting the catalytic domain or some portion thereof would be replaced, rendered inactive and fused with the desired agent or molecule. Acid sensitive or protease sensitive cleavage sites could be inserted between the remnant of the catalytic domain and the desired agent or molecule.

Agents or molecules that might be coupled to modified toxins such as disclosed herein include but are not limited to; peptides or protein fragments, nucleic acids, oligonucleotides, acid insensitive proteins, glycoproteins, proteins or novel chemical entities that required selective delivery.

Therefore, it should be understood that changes may be made in the particular embodiments disclosed which are within the scope of what is described.

Side-Effects

Modifications to the toxins and cell binding moieties described herein may lead to reduction of one or more side effects currently observed with administration of ONTAK®. Current adverse drug events (ADEs)/toxicity include one or more of the following: capillary leak syndrome, dehydration, hypotension, fever, hypoalbuminemia, skin disorder, chest pain, vascular fragility, fatigue, hypersensitivity, myocardial ischemia, urinary tract infection, decreased blood pressure, joint stiffness, myalgia, carpel tunnel syndrome, loss of consciousness, respiratory distress, dermatitis exfoliative, erythema, and generalized rash, hypersensitivity. Reduction in one or more adverse drug events (ADEs)/toxicity may be by about 1.5 fold, about 2 fold, about 3 fold, about 4 fold, about 5 fold, about 6 fold, about 7 fold, about 8 fold, about 9 fold, about 10 fold, about 15 fold, about 20 fold, about 30 fold, about 40 fold, or about 50 fold or more (or any integer there between).

Treatment of diseases with compounds alone or in combination with other antineoplastic compounds may be accompanied by administration of pharmaceutical agents that can alleviate the side effects produced by the antineoplastic agents. Such agents suitable for use herein include, but are not limited to, anti-emetics, anti-mucositis agents, pain management agents, infection control agents, and anti-anemia/anti-thrombocytopenia agents. Examples of anti-emetics suitable for use herein include, but are not limited to, 5-hydroxytryptamine 3 receptor antagonists, metoclopramide, steroids, lorazepam, ondansetron, cannabinoids, their analogues and derivatives. Examples of anti-mucositis agents suitable for use herein include, but are not limited to, palifermin (keratinocyte growth factor), glucagon-like peptide-2, teduglutide, L-glutamine, amifostin, and fibroblast growth factor 20. Examples of pain management agents suitable for use herein include, but are not limited to, opioids, opiates, and non-steroidal anti-inflammatory compounds. Examples of agents used for control of infection suitable for use herein include, but are not limited to, antibacterials such as aminoglycosides, penicillins, cephalosporins, tetracyclines, clindamycin, lincomycin, macrolides, vancomycin, carbapenems, monobactams, fluoroquinolones, sulfonamides, nitrofurantoins, their analogues and derivatives. Examples of agents that can treat anemia or thrombocytopenia associated with chemotherapy suitable for use herein include, but are not limited to, erythropoietin, and thrombopoietin.

Several other suitable therapies for use in combination with the modified DT toxin fusion proteins and other compounds described herein are also available. For example, see *Goodman & Gilman's The Pharmacological Basis of Therapeutics* 11th ed. Brunton L L, Lazo J S, and Parker K L, ed. McGraw-Hill, New York, 2006.

Provided herein are uses of the compounds described herein in the formulation of a medicament for the treatment of a disease described herein.

XI. Packages and Kits

In still further embodiments, the present application concerns kits for use with the compounds described above. Toxins exhibiting reduced immunogenicity, VLS promoting or toxic effects, or combinations thereof can be provided in a kit. Such kits may be used to combine the toxin with a specific cell binding ligand to produce a fusion protein that targets a particular receptor on a cell (e.g., IL-2 receptors on cancer cells) in a ready to use and storable container. The kits will thus comprise, in suitable container means, a composition with reduced immunogenicity, VLS promoting or toxic effects, or combinations thereof. The kit may comprise a modified DT or a fusion protein thereof in suitable container means.

The container means of the kits will generally include at least one vial, test tube, flask, bottle, syringe and/or other container means, into which the at least one polypeptide can be placed, and/or preferably, suitably aliquoted. The kits can include a means for containing at least one fusion protein, detectable moiety, reporter molecule, and/or any other reagent containers in close confinement for commercial sale.

Such containers may include injection and/or blow-molded plastic containers in which the desired vials are stored. Kits can also include printed material for use of the materials in the kit.

Packages and kits can additionally include a buffering agent, a preservative and/or a stabilizing agent in a pharmaceutical formulation. Each component of the kit can be enclosed within an individual container and all of the various containers can be within a single package. Invention kits can be designed for cold storage or room temperature storage.

Additionally, the preparations can contain stabilizers (such as bovine serum albumin (BSA)) to increase the shelf-life of the kits. Where the compositions are lyophilized, the kit can contain further preparations of solutions to reconstitute the lyophilized preparations. Acceptable reconstitution solutions are well known in the art and include, for example, pharmaceutically acceptable phosphate buffered saline (PBS).

Additionally, the packages or kits provided herein can further include any of the other moieties provided herein such as, for example, one or more reporter molecules and/or one or more detectable moieties/agents.

Packages and kits can further include one or more components for an assay, such as, for example, an ELISA assay, cytotoxicity assay, ADP-Ribosyltransferase activity assay, etc. Samples to be tested in this application include, for example, blood, plasma, and tissue sections and secretions, urine, lymph, and products thereof. Packages and kits can further include one or more components for collection of a sample (e.g., a syringe, a cup, a swab, etc.).

Packages and kits can further include a label specifying, for example, a product description, mode of administration and/or indication of treatment. Packages provided herein can include any of the compositions as described herein. The package can further include a label for treating a cancer.

The term "packaging material" refers to a physical structure housing the components of the kit. The packaging material can maintain the components sterilely, and can be made of material commonly used for such purposes (e.g., paper, corrugated fiber, glass, plastic, foil, ampules, etc.). The label or packaging insert can include appropriate written instructions. Kits, therefore, can additionally include labels or instructions for using the kit components in any method of the invention. A kit can include a compound in a pack, or dispenser together with instructions for administering the compound in a method described herein.

Instructions can include instructions for practicing any of the methods described herein including treatment methods. Instructions can additionally include indications of a satisfactory clinical endpoint or any adverse symptoms that may occur, or additional information required by regulatory agencies such as the Food and Drug Administration for use on a human subject.

The instructions may be on "printed matter," e.g., on paper or cardboard within or affixed to the kit, or on a label affixed to the kit or packaging material, or attached to a vial or tube containing a component of the kit. Instructions may additionally be included on a computer readable medium, such as a disk (floppy diskette or hard disk), optical CD such as CD- or DVD-ROM/RAM, magnetic tape, electrical storage media such as RAM and ROM, IC tip and hybrids of these such as magnetic/optical storage media.

EXAMPLES

The application may be better understood by reference to the following non-limiting examples, which are provided as exemplary embodiments of the application. The following examples are presented in order to more fully illustrate embodiments of the invention and should in no way be construed, however, as limiting the broad scope of the application. While certain embodiments of the present application have been shown and described herein, it will be obvious that such embodiments are provided by way of example only. Numerous variations, changes, and substitutions will now occur to those skilled in the art without departing from the invention. It should be understood that various alternatives to the embodiments described herein may be employed in practicing the methods described herein.

Example 1

Construction, Expression and Purification of DT Variants and DT-Fusion Proteins Construction of DT Variant and DT-Fusion Proteins A truncated DT-based toxophore comprising a methionine residue at the N-terminus and amino acid residues 1 through 386 (SEQ ID NO: 2) of the native DT (now residues 2-387 in the truncated toxophore) is constructed as DT387 or residues 1-382 of DT387. The DT-based toxophore can also comprise a methionine residue at the N-terminus, amino acid residues 1 through 386 (SEQ ID NO: 2) of the native DT (now residues 2-387 in the truncated toxophore), and residues 484-485 of native DT, constructed as DT389. DT387 and DT389 contains three (x)D(y) motifs at residues 7-9 (VDS), residues 29-31 (VDS), and residues 290-292 (IDS). DT382 contains residues 1-382 of DT387 or DT389. Other C-terminal truncated DT constructs as described herein can be used in the assays provided herein for testing functionality of DT variants. One would understand that modifications made to DT389 also could be made in a truncated construct (e.g., DT382) and tested for functionality. Example 20 provides exemplary amino acid sequences of wild type DT382, DT382 variants, and null construct DT382(G53E): underlined sequences are vector/tag sequences; enterokinase cleavage site highlighted in italicized text; and mutations from WT sequences are shown in bold text.

Site directed mutagenesis is employed to alter the (x)D(y) motif in DT. A Stratagene Quickchange mutagenesis kit is used to construct the mutations. Oligonucleotide primers are designed to alter encoding residues within the (x)D(y) motif implicated in VLS.

The mutants are tested in the context of protein fusion toxin genetically fused to sequences encoding human interleukin 2 (SEQ ID NO: 3 or 588) or a cell binding portion thereof. DT-fusion proteins are expressed and purified.

Expression and Purification of DT Variants and DT-Fusion Proteins

Plasmid constructs encoding truncated and/or modified DT protein, modified DT mutants, and modified DT-fusion protein are transformed into *E. coli* HMS 174 (DE3) cells. *E. coli* HMS 174 is a protease-deficient strain in which over-expression of recombinant proteins can be achieved. Induction of the recombinant protein expression is obtained by addition of isopropylthiogalactosidase (IPTG) to *E. coli* HMS 174. Following incubation, the bacterial cells are harvested by centrifugation and lysed, and the recombinant protein is further purified from inclusion body preparations as described by Murphy and vanderSpek, Methods in Molecular Biology, Bacterial Toxins:methods and protocols, 145:89-99 Humana press, Totowa, N.J. (2000). It may be necessary to remove endotoxin from the protein preparations to assure that effects on HUVECs are from VLS and not due to the presence of the endotoxins. Endotoxin is removed to <250 EU/ml by passage over an ion-exchange resin. Separation of breakdown products from full-length material also occurs during ion-exchange chromatography. After another final purification over ion exchange resin, endotoxin is reduced to <25 EU/ml and the toxophore is tested for VLS as a function of HUVEC cell binding in vitro. Analysis of $DT_{387}$ or$DT_{389}$ toxophore can be conducted using Coomassie Blue staining and Western Blot when samples from the process described above are resolved by SDS Polyacrylamide Gel Electrophoresis (PAGE) using conventional techniques described herein and known in the art.

Mutations that result in stable constructs with adequate expression that do not affect ribosyltransferase activity of the $DT_{387}$ or$DT_{389}$ toxophore can be subsequently tested for targeted cytotoxicity in the corresponding VLS modified DT-EGF and VLS modified DT-IL-2 protein fusion toxins (Example 5, respectively).

Example 2

Cell Permeability Assays

Human vascular endothelial cells are maintained in EGM media (obtained from Cambrex, Walkersville, Md.). Subconfluent early passage cells are seeded at equivalent cell counts onto plastic cover slips. Purified, endotoxin free wild type DT toxophore and mutants are labeled with the fluorescent tag F-150 (Molecular Probes, Eugene, Oreg.) through chemical conjugation. HUVECs are incubated with equivalent amounts of the labeled toxophores. The media is then aspirated, and the cells are then washed, fixed and prepared for analysis. Examination of the cells on cover slips from different treatment groups permits the analysis of the number of cells labeled by the fluorescent toxophore. No targeting ligand is present on the toxophore and, consequently, the level of HUVEC interaction is proportional only to the toxophores affinity for HUVECs. Comparisons are carried out using a fluorescent microscope and comparing the number of cells labeled from at least ten independent fields, different cover slips or different slides. DAPI stain is used to localize cells, particularly in the case of the mutant constructs as cell labeling is not readily apparent. 4'-6-Diamidino-2-phenylindole (DAPI) is known to form fluorescent complexes with natural double-stranded DNA; as such DAPI is a useful tool in various cytochemical investigations. When DAPI binds to DNA, its fluorescence is strongly enhanced. Thus, DAPI serves as a method of labeling cell nuclei. In contrast, cells treated with F-150DT toxophore are easily observed. To facilitate that quantification of the mutant DT toxophore constructs the signal intensity and changes in background signal are also increased.

Effect of the DT variant IL-2 fusion proteins on the morphology of HUVEC monolayers can also be assessed according to methods described, by example, Baluna et al. (Int. J. Immunopharm., 18:355-361, 1996) and Soler-Rodriguez et al. (Exp. Cell Res., 206:227-234, 1993). To determine whether the VLS sequences in DT and IL-2 damage HUVECs, monolayers are incubated with different concentrations of DT variants, DT variant-IL-2-fusion proteins, or controls. HUVECs are isolated, cultured and studied microscopically. Briefly, HUVEC monolayers are incubated at 37° C. for 18 hours with $10^{-6}$ M of each variant, fusion protein, control, or medium-only and then examined by phase-contrast microscopy (magnification at 20 times). Normal monolayers consist of highly packed cells with elongated shapes, whereas damaged cells round up and detach from the plate. Untreated HUVECs consist of tightly packed elongated cells. Monolayers can be assessed after 2 hours for cell rounding after 2 hr of incubation and after 18 hours for formation of gaps in the monolayer. Toxic effects on HUVECs are assessed.

Another method for measuring permeability of endothelial monolayers in vitro has been described in detail previously (Friedman et al. J. Cell. Physiol., 129: 237-249 (1986); Downie et al. Am. J. Resp. Cell. Mol. Biol., 7(1): 58-65 (1992)). After incubation with the various media described, the filters containing confluent endothelial cells are washed 2 times with PBS. The filters with attached endothelial cells are then mounted in modified flux chambers, and the chambers placed in a culture dish. The upper well of the chamber is filled with serum-free medium containing 50 mM Hepes. The dish is filled with the same medium. A stirring bar is added to the lower well, and the entire chamber placed on an electrical stirring device and incubated at 37° C. The chamber is incubated until the level of media between the upper well and the surrounding fluid in the beaker is equal. Thus, no hydrostatic pressure difference is present between the upper and lower wells. After this equilibration period, a small aliquot of medium in the upper well is removed and replaced with medium containing [$^{125}$I]bovine serum albumin (30,000 cpm/ml). The radiolabeled albumin is extensively dialyzed against 1 M PBS immediately before use. Chromatographic monitoring of the dialyzed [$^{125}$I]albumin as well as the media in the lower well after the end of the study is demonstrated >95% of the $^{125}$I to co-chromatograph with albumin (Friedman et al. J. Cell. Physiol., 129: 237-249 (1986)). Small aliquots of media (in triplicate) are removed serially from both the upper and lower wells 10, 30, 60, 120, 180, and 240 min after the addition of the $^{125}$I probe. The $^{125}$I activity in each aliquot is measured in a gamma counter, and the average cpm/ml for the samples from the upper and lower wells is determined. Appropriate corrections are made for background using the experimental media. The [$^{125}$I] albumin transfer rate of the BPAEC monolayers is expressed as the rate of appearance of counts in the lower well relative to the number of counts in the upper well/hour over the 90 to 240-min period of steady-state clearance (Friedman et al. J. Cell. Physiol., 129: 237-249 (1986)). Each albumin transfer rate point ("n") represents the average rate of duplicate filters within a group. Each group of filters included duplicate control filters (i.e., monolayers on filters incubated with diluent alone). In additional filters, non-radiolabeled bovine serum albumin (final concentration of 1%) is added along with [$^{125}$I]bovine serum albumin in the upper well. The [$^{125}$I]albumin transfer rate across the monolayer is determined using the previously described method. The endothelial monolayers is expected to be more intact after exposure to DTvariant-IL-2 fusion proteins compared to unmodified DT-IL-2 fusion proteins.

In yet another assay, channel-forming activities of the mutants of DT-IL-2 are determined using a planar lipid bilayer membrane system (vanderSpek et al., J. Biol. Chem. 268: 12077-12082 (1993); Silverman et al., J. Membr. Biol. 137: 17-28 (1994); Hu et al. Prot. Eng. 11(9): 811-817 (1998)) and compared to unmodified DT-IL-2. The membranes are formed across 50-100 µm apertures are made in polystyrene cups. A 1% hexane solution of lecithin type IIS (Sigma) with the neutral lipids removed (Kagawa and Racker, Biol. Chem. 246: 5477-5487(1971)) is used to coat both sides of the aperture and allowed to dry. The outside of the aperture is then coated with a 1.5% squalene solution prepared in light petroleum. The cup is placed in the back chamber of a block prepared by Warner Instruments (Hamden, Conn.). A buffer solution (1 M KCl, 2 mM $CaCl_2$, 1 mM EDTA, 50 mM HEPES, pH 7.2) is added to the cup to above the level of the aperture (0.5 ml). The front chamber of the block is filled with 1.0 ml of the same buffer solution, except with 30 mM MES, pH 5.3, instead of the HEPES. A 50 µl aliquot of the lecithin hexane solution is layered on top of the buffer in the front chamber and the hexane is allowed to evaporate. The buffer in the front chamber is then lowered and raised above the level of the aperture and the planar lipid bilayer is formed. Unmodified DT-IL-2 fusion proteins and DT variant-IL-2 fusion proteins thereof are added to the front chamber at concentrations ranging from 20 to 730 ng/ml. A voltage of +60 mV is applied across the membrane using voltage clamp conditions. The back chamber of the block, containing the cup, is held at virtual ground and the voltages refer to the front chamber to which the proteins are added. Current is monitored using standard methods Oakes et al., J. Biol. Chem. 265: 6984-6991 (1989)). Channel conductances are determined using the equation g=I/V, where g is the conductance, I is the current flowing through the membrane and V is the voltage applied across the membrane. The lipid bilayer is expected to be more intact after exposure to DTvariant-IL-2 fusion proteins compared to unmodified DT-IL-2 fusion proteins.

Example 3

This example describes a method for testing ADP-Ribosyltransferase Activity. Ribosome inactivating protein toxins, such as diphtheria toxin, catalyze the covalent modification of translation elongation factor 2 (EF-2). Ribosylation of a modified histidine residue in EF-2 halts protein synthesis at the ribosome and results in cell death. Ribosyltransferase assays to determine catalytic activity of the $DT_{387}$ mutants are performed in 50 mM Tris-C1, pH8.0, 25 mM EDTA, 20 mM Dithiothreitol, 0.4 mg/ml purified EF-2, and 1.0 pM [$^{32}$P]-$NAD^+$ (10 mCi/ml, 1000 Ci.mmol, Amersham-Pharmacia). The purified mutant proteins are tested in a final reaction volume of 40 µl. The reactions are performed in 96 well, V-bottom microtiter plates (Linbro) and incubated at room temperature for an hour. Proteins are precipitated by addition of 200 µl 10% TCA and collected on glass fiber filters, and radioactivity is determined by standard protocols. Traditional methods for measuring ADP-ribosylation use permeabilized cells treated with double stranded (ds) activator DNA oligonucleotide; subsequent measurement of radiolabeled NAD+ is incorporated into acid insoluble material. FACS-based methods such as those described by Kunzmann et al. (Immunity & Ageing, 3:8 (2006)) are also available.

Example 4

Cytotoxicity Assays on Crude Extracts of Modified DT-IL-2 Fusion Proteins

The DT387 orDT389 construct is initially used to demonstrate that modified toxophores can be chemically coupled to a number of targeting ligands and yield functional targeted toxins. Single chain fusions toxins, as exemplified by DT387linkerIL-2 or DT389linkerIL-2, circumvent the scale-up purification problems typically encountered in the development of conjugate toxins. To confirm the effects of the engineered changes, a number of modified DT387 IL-2 fusion or DT389 IL-2 fusion toxins are produced and tested in cytotoxicity assays.

Amino acid substitutions made, as described above; to determine that the changes do not yield inactive toxophores incapable of producing fusion toxins, cytotoxicity assays are performed.

Cytotoxicity Assays

Cytotoxicity assays are performed using HUT102/6TG cells, a human HTLV1 transformed T-cell line that expresses high affinity Interleukin-2 receptors. HUT102/6TG cells are maintained in RPMI 1640 (Gibco) media supplemented with 10% fetal bovine serum, 2 mM glutamine, 50 IU/ml penicillin and 50 µg/ml streptomycin. The cells are seeded at a density of $5 \times 10^4$/well into 96 well, V-microtiter plates. The fusion protein toxins are typically added to the wells in molarities ranging from $10^{-7}$ M to $10^{-12}$ M. Final volume in the wells is 200 µl. The plates are incubated for 18 hours, at 37° C. in a 5% $CO_2$ environment. The plates are subjected to centrifugation to pellet the cells, the media removed and replaced with 200 µl leucine-free, minimal essential medium containing 1.0 µCi/ml[$^{14}$C] leucine (<280 mCi/mmol, Amersham-Pharmacia) and 21 mM glutamine, 50 IU/ml penicillin and 50 µg/ml streptomycin. The cells are pulsed for 90 minutes and then the plates subjected to centrifugation to pellet the cells. The supernatant is removed and the cells are lysed in 60 µl, 0.4 M KOH followed by a 10 minute incubation at room temperature. 140 µl of 10% TCA is then added to each well and another 10 minute, room temperature incubation is performed. The precipitated proteins are collected on glass fiber filters using a PHD cell harvester and the incorporated radioactivity is determined using standard methods. The results are reported as a percentage of control (no fusion protein added to inhibit protein synthesis) [$^{14}$C]-leucine incorporation. Toxilight™, Vialight™ and ALA-MARBLUE™ kits are non-radioactive, commercial assays which can be used to assess the variants. The assays are conducted in a 96-well plate format, titrating toxin ($10^{-7}$-$10^{-12}$ M) over time using susceptible and resistant cell lines.

Pharmaceutical grade GMP purified $DAB_{389}IL$-2 produced from E. coli typically yields an $IC_{50}$ of between $5 \times 10^{-11}$ M to $1 \times 10^{-12}$ M. Partially purified toxins exhibit activity between 10-100 fold lower in partially purified non-homogenous extracts. Pharmaceutical grade toxins are purified to homogeneity and the active fractions of refolded fusion toxins are used as biologically active drug. In the example above we utilize a moderate through put analysis to determine the receptor specific cytotoxicity of partially purified modified DT-IL-2 fusion toxins and compared them to the activity of similarly purified $DAB_{389}IL$-2. These assays demonstrate comparable activity of the modified $DT_{387}$linker IL-2 fusion to $DAB_{389}IL$-2. It should be noted that the calculation of specific cytotoxicity was based upon the total amount of protein in the samples of partially fusion toxin. For assays equimolar concentrations of fusion toxins were tested.

The relative amounts of non-fusion toxins protein in each sample could artificially alter the IC50 of any given construct. That is, the presence of non full length or non fusion toxin protein in the samples used in this analysis could potentially account for small differences in $IC_{50}$.

Purified $DAB_{389}IL$-2 produced in E. coli typically yields an $IC_{50}$ of between $5 \times 10^{-11}$ M and $1 \times 10^{-12}$ M.

A moderate throughput cytotoxicity assay is used to analyze crude purifications of modified DT-IL-2 fusion toxins and compare them to the activity of similarly purified $DT_{387}$linkerIL-2.

It should be noted that there is one (x)D/E(y) motif in IL-2 located at residues 19-21 (LDL). The contribution of IL-2 to VLS can be determined by modifying the (x)D/E(y) motif in the IL-2 and test the modified protein using the cytotoxicity assay described above. For example, using modified DT mutants derived from $DT_{387}$ or $DT_{387}$linker IL-2, it is possible to distinguish between effects of the mutations on catalytic activity, VLS activity and effective delivery of the targeted toxin to the cytosol of target cells. The comparison between modified DT mutants of $DT_{387}$ and $DT_{387}$linker IL2 will also separate the effects of modified sequences of the toxophore alone from the IL-2 targeting ligand present in $DT_{387}$linker IL-2. In another example, using modified DT mutants derived from both $D_{T389}$ and $DT_{389}$linker IL-2, it is possible to distinguish between effects of the mutations on catalytic activity, VLS activity and effective delivery of the targeted toxin to the cytosol of target cells. The comparison between modified DT mutants of $D_{T389}$ and $DT_{389}$linker IL2 will also separate the effects of modified sequences of the toxophore alone from the IL-2 targeting ligand present in $DT_{389}$linker IL-2.

Example 5

This example describes an in vivo method to test the effect of fusion proteins described herein. A model has been developed to study the effect of toxin-containing fusion proteins on human endothelium in vivo by grafting vascularized human skin onto SCID mice, injecting the mice with toxin-containing fusion proteins and measuring fluid accumulation in the graft as the wet/dry weight ratio (Baluna et al., J. Immunother., 22(1):41-47 (1999)). Fluid accumulation in the human skin is measured by weighing punch biopsies of the skin grafts before and after freeze drying. This model can be used to evaluate the effect of the modified DT fusion proteins described herein in vivo.

The fluid accumulation in the lungs of normal SCID mice is also used as a surrogate model for VLS. IL-2 has been shown to induce fluid accumulation in the lungs of mice (Orucevic and Lala, J. Immunother. Emphasis Tumor Immunol., 18(4):210-220 (1995)). The water content of the lungs or skin grafts is calculated as the wet/dry weight ratio. In this model, pulmonary vascular leak can also be assessed by measuring the accumulation in the lungs of $^{125}$I-albumin injected intravenously according to the methods described by Smallshaw et al., (Nature Biotechnology 21:387-391 (2003)).

Example 6

Multiple assays are available to test the function of DT variants described herein such as, for example, in vitro cytotoxicity assays, in vitro vascular toxicity, in vivo mouse models as well as any other assay described herein or known in the art.

In Vitro Cytotoxicity Assays

The cytotoxic activities of the different modified DT fusion proteins are determined using CD22$^+$ Daudi cells and [$^3$H]-leucine incorporation as described previously (Ghetie et al., 1988). The concentration of fusion protein which reduces [$^3$H]-leucine incorporation by 50% relative to an untreated control culture is defined as the IC$_{50}$.

Vascular Toxicity

As a first step in evaluating the ability of fusion proteins prepared with modified DTs to induce vascular damage, a series of in vitro studies using HUVECs can be conducted. For in vitro assays, the effect of modified DT fusion proteins on the morphology of HUVEC monolayers is tested as described previously (Baluna et al., 1996).

In Vivo Assays

The effects of modified DT fusion proteins can be determined in the SCID/Daudi tumor model (Ghetie et al., 1992). Briefly, female SCID mice are injected intravenously (I.V.; lateral tail vein) with 5×10$^6$ Daudi cells on day zero. Fusion proteins are injected I.V. on days 1, 2, 3 and 4. Groups of 5 mice are used for each treatment and studies are repeated. Treatment groups receive (1) no treatment (control); (2) unmodified DT fusion proteins; or (3) modified DT fusion proteins. Mice are followed and sacrificed when the paralysis of their hind legs occurs. Pulmonary vascular leak in SCID mice is evaluated as described (Baluna et al., 1999). The water content of the lungs is calculated as the wet/dry weight ratios of lungs removed from mice injected with 10 µg modified DT fusion protein/g of mouse weight.

Example 7

This example describes a method of screening a toxin for T-cell epitopes. The interaction between MHC, polypeptide and T cell receptor (TCR) provides the structural basis for the antigen specificity of T cell recognition. T cell proliferation assays test the binding of polypeptides to MHC and the recognition of MHC/polypeptide complexes by the TCR. In vitro T cell proliferation assays of the present example, involve the stimulation of peripheral blood mononuclear cells (PBMCs), containing antigen presenting cells (APCs) and T cells. Stimulation is conducted in vitro using synthetic peptide antigens. Stimulated T cell proliferation is measured using $^3$H-thymidine ($^3$H-Thy) and the presence of incorporated $^3$H-Thy is assessed using scintillation counting of washed fixed cells.

Buffy coats from a donor pool of human blood stored for less than 12 hours are obtained, and polypeptide libraries corresponding to the amino acid residue sequence of the toxin are synthesized via known methods or obtained from an appropriate source. Erythrocytes and leukocytes are separated from plasma and platelets by gentle centrifugation of buffy coats. The top phase (containing plasma and platelets) is removed and discarded. Erythrocytes and leukocytes were diluted 1:1 in phosphate buffered saline (PBS) before layering onto 15 ml ficoll-paque (GE Healthcare). Centrifugation is done according to the manufacturers recommended conditions and PBMCs are harvested from the serum+PBS/ficoll plaque interface. PBMCs are mixed with PBS (1:1) and collected by centrifugation. The supernatant is removed and discarded and the PBMC pellet is resuspended in 50 ml PBS. Cells are again pelleted by centrifugation and the PBS supernatant discarded. Cells are then resuspended using 50 ml AIM V media and at this point counted and viability assessed using trypan blue dye exclusion. Cells are again collected by centrifugation and the supernatant discarded.

Cells are resuspended for cryogenic storage at a density of $3\times10^7$ per ml. The storage medium is 90% (v/v) heat inactivated AB human serum (Invitrogen) and 10% (v/v) DMSO (Invitrogen). Cells are transferred to a regulated freezing container and placed at −70° C. overnight before transferring to liquid $N_2$ for long term storage. When required for use, cells are thawed rapidly in a water bath at 37° C. before transferring to 10 ml pre-warmed AIM V medium.

PBMCs are stimulated with polypeptide antigens in a 96 well flat bottom plate at a density of $2\times10^5$ PBMC per well. PBMC were incubated for 7 days at 37° C. before pulsing with $^3$H-Thy. Synthetic polypeptides (15 mers) that overlapped by increments of 12 amino acids are generated that span the entire sequence of the toxin.

Each polypeptide is screened individually against PBMCs isolated from 20 naive donors. Two control polypeptides that have previously been shown to be immunogenic and a potent non-recall antigen, KLH, are used in each donor assay. The control antigens used are Flu haemagglutinin; Chlamydia HSP 60 peptide and Keyhole Limpet hemocyanin. Polypeptides are dissolved in DMSO to a final concentration of 10 mM, these stock solutions are then diluted 1/500 in AIM V media (final concentration 20 µM). Polypeptides are added to a flat bottom 96 well plate to give a final concentration of 2 and 20 µM in a 100 µl. The viability of thawed PBMCs is assessed by trypan blue dye exclusion, and cells are then resuspended at a density of $2\times10^6$ cells/ml, and 100 µl ($2\times10^5$ PBMC/well) is transferred to each well containing peptides. Triplicate well cultures are assayed at each peptide concentration. Plates are incubated for 7 days in a humidified atmosphere of 5% $CO_2$ at 37° C. Cells are pulsed for 18-21 hours with 1 µCi $^3$H-Thy/well before harvesting onto filter mats. CPM values are determined using a microplate beta top plate counter. Results are expressed as stimulation indices, where the stimulation index (SI) is derived by division of the proliferation score (e.g. counts per minute of radioactivity) measured to the test peptide by the score measured in cells not contacted with a test peptide.

Example 8

Deimmunization has been successfully applied to generate T cell epitope-depleted variants of several proteins including plant (EP1737961) and bacterial (WO2004/018684) toxins. Deimmunization technology has been improved, such as through the development of EPISCREEN® (Antitope, Ltd., Cambridge, UK) which is more sensitive for measuring T cell epitopes.

T cell epitopes can be removed by replacement with sequence segments from other proteins using Composite Protein™ technology (Antitope, Ltd.) rather than introduction of point mutations which, as a result, provides a more flexible solution in removing T cell epitopes while retaining protein function.

The methods described herein are to generate variants of DT with reduced VLS and reduced immunogenicity:

T cell epitope mapping of DT and the junction with a selected ligand, e.g., human IL-2;

assays for VLS and DT activity;

gene synthesis, expression and purification of whole DT in E. coli in a format suitable for screening multiple variants (approximately 100-250 variants);

generation and testing of DT variants for reduced VLS (HUVEC binding assay)—variants are tested in two rounds (single locus/multiple loci);

generation and testing of DT variants after removal of T cell epitopes—variants are tested in rounds (single epitope, multiple epitope, optimization) with the second round involving combination with VLS variants (stage 4);

generation of lead DT-fusion variant by fusion of lead DT variant from stage 5 with a protein ligand such as human IL-2 and purification/testing of protein (this stage is optional); and immunogenicity testing of lead DT 1-389 ('truncated DT (ΔR)') variant by EPISCREEN® (control of wild-type truncated DT (ΔR)).

Testing of the DT variants containing mutations in VLS motifs in the HUVEC binding assay as well as testing of all DT variants for potency in the IVTT assay is done with, for example, truncated DT variants without the wild-type receptor binding (R) domain (DT (ΔR)). Testing of leads for potency in cytotoxicity assays is performed with both full length DT versions as well as fusion proteins in which DT(AR) is fused to IL-2. For EPISCREEN® validation of one or more lead DT variants, the optimized DT variants with modified C and I domains are tested by expression of truncated DT (ΔR).

Example 9

EPISCREEN® T Cell Epitope Mapping of DT
EPISCREEN® Donor Selection

Peripheral Blood Mononuclear cells (PBMC) were isolated from healthy community donor buffy coats (from blood drawn within 24 hours) which were obtained from the UK National Blood Transfusion Service (Addenbrooke's Hospital, Cambridge, UK) according to approval granted by Addenbrooke's Hospital Local Research Ethics Committee. PBMC were isolated from buffy coats by Lymphoprep (Axis-shield, Dundee, Scotland) density centrifugation and CD8+ T cells were depleted using CD8+ RossetteSep™ (StemCell Technologies, Inc.). Donors were characterized by identifying HLA-DR haplotypes using a Biotest HLA SSP-PCR based tissue-typing kit (Biotest, Landsteinerstraße, Denmark). T cell responses to a control antigen, Keyhole Limpet Haemocyanin (KLH) (Pierce, Rockford, USA) were also determined. A cohort of 54 donors was selected to best represent the number and frequency of HLA-DR allotypes expressed in the world population (Table 1 and data not shown). Analysis of the allotypes expressed in the cohort against those expressed in the world population revealed that coverage of >80% was achieved and that all major HLA-DR alleles (individual allotypes with a frequency >5% expressed in the world population) were well represented. Table 1 shows donor haplotypes and a comparison of responses to KLH obtained during the processing and isolation of donor PBMC (test 1) against donor responses obtained after re-testing during this study (ANG01). A summary of donor haplotypes is provided in Table 2.

TABLE 2

Donor details and haplotypes.

| Donor No. | Haplotype | KLH Test 1 | KLH Test 2 |
|---|---|---|---|
| 1 | DRB1*01, DRB1*15, DRB5 | 5.29 | 2.15 |
| 2 | DRB1*07, DRB1*14, DRB3, DRB4 | 2.7 | 2.61 |
| 3 | DRB1*04, DRB4 | 2.83 | 2.01 |
| 4 | DRB1*04, DRB4 | 8.06 | 2.04 |
| 5 | DRB1*08, DRB1*14, DRB3 | 5.99 | 2.74 |
| 6 | DRB1*04, DRB1*07, DRB4 | 3.56 | 2.04 |
| 7 | DRB1*03, DRB1*15, DRB3 | 5.09 | 12.85 |
| 8 | DRB1*04, DRB1*14, DRB3, DRB4 | 3.69 | 4.00 |
| 9 | DRB1*01, DRB1*03, DRB3 | 2.46 | 1.53 |
| 10 | DRB1*15, DRB1*03, DRB3, DRB5 | 1.74 | 1.24 |
| 11 | DRB1*03, DRB1*13, DRB3 | 2.68 | 2.96 |
| 12 | DRB1*07, DRB1*15, DRB4, DRB5 | 4.32 | 2.71 |
| 13 | Donor excluded | | |
| 14 | DRB1*01, DRB1*03, DRB3 | 5.9 | 8.35 |
| 15 | DRB1*04, DRB1*08, DRB4 | 4.41 | 9.15 |
| 16 | DRB1*15, DRB1*13, DRB3, DRB5 | 11.07 | 4.84 |
| 17 | DRB1*03, DRB3 | 8.21 | 2.10 |
| 18 | DRB1*01, DRB1*03, DRB3 | 3.64 | 1.50 |
| 19 | DRB1*04, DRB1*14, DRB3, DRB4 | 3.65 | 2.43 |
| 20 | Donor excluded | | |
| 21 | DRB1*03, DRB1*07, DRB3, DRB4 | 1.5 | 1.26 |
| 22 | DRB1*01, DRB1*07, DRB4 | 1.08 | 1.62 |
| 23 | DRB1*04, DRB1*07, DRB4 | 11.111 | 2.39 |
| 24 | DRB1*07, DRB1*13, DRB3, DRB4 | 12.39 | 2.24 |
| 25 | DRB1*04, DRB1*11, DRB3, DRB4 | 8 | 2.23 |
| 26 | DRB1*07, DRB1*13, DRB3, DRB4 | 10.75 | 4.06 |
| 27 | DRB1*03, DRB3 | 2.64 | 2.25 |
| 28 | DRB1*07, DRB1*13, DRB3, DRB4 | 5.31 | 3.36 |
| 29 | DRB1*01, DRB1*03, DRB3 | 4.53 | 2.32 |
| 30 | DRB1*15, DRB1*03, DRB3, DRB5 | 2.72 | 13.17 |
| 31 | DRB1*01, DRB1*04, DRB4 | 5.86 | 3.67 |
| 32 | DRB1*01, DRB1*04, DRB4 | 4.61 | 4.20 |
| 33 | DRB1*03, DRB1*04, DRB3, DRB4 | 1.4 | 0.92 |
| 34 | DRB1*15, DRB1*03, DRB3, DRB5 | 3.89 | 3.60 |
| 35 | DRB1*15, DRB1*04, DRB4, DRB5 | 2.38 | 1.86 |
| 36 | DRB1*09, DRB1*15, DRB4, DRB5 | 3.65 | 2.94 |
| 37 | DRB1*15, DRB1*13, DRB3, DRB5 | 3.81 | 0.91 |
| 38 | Donor excluded | | |
| 39 | DRB1*04, DRB1*13, DRB3, DRB4 | 4.19 | 2.12 |
| 40 | DRB1*01, DRB1*03, DRB3 | 3.64 | 19.93 |
| 41 | DRB1*07, DRB1*11, DRB3, DRB4 | 3.74 | 4.53 |
| 42 | DRB1*08, DRB1*11, DRB3 | 3.76 | 1.97 |
| 43 | DRB1*04, DRB1*13, DRB3, DRB4 | 2.2 | 2.71 |
| 44 | DRB1*08, DRB1*13, DRB3 | 3.95 | 5.02 |
| 45 | DRB1*03, DRB1*13, DRB3 | 532 | 3.06 |
| 46 | DRB1*11, DRB1*15, DRB3, DRB5 | 1.59 | 3.89 |
| 47 | DRB1*11, DRB1*15, DRB3, DRB5 | 1.31 | 7.79 |
| 48 | DRB1*04, DRB1*16, DRB4, DRB5 | 3.82 | 2.86 |
| 49 | DRB1*04, DRB1*13, DRB3, DRB4 | 6.04 | 2.20 |
| 50 | DRB1*11, DRB1*14, DRB3 | 10.23 | 5.66 |
| 51 | DRB1*04, DRB1*07, DRB4 | 4.11 | 2.18 |
| 52 | DRB1*01, DRB1*07, DRB4 | 4.51 | 2.03 |
| 53 | DRB1*04, DRB1*12, DRB3, DRB4 | 0.82 | 1.16 |
| 54 | DRB1*11, DRB3 | 3.42 | 2.02 |

Donor responses (SI) to KLH are shown for two independent tests.
Test 1 was performed on freshly isolated PBMC and ANG01 is the re-test in the current study.
Responses that did not produce the same result (i.e., positive or negative) in both tests are highlighted in bold italics.
Three donors with very low basal cpm (<150 cpm) were excluded from the analysis.

Table 2. Donor details and haplotypes. Donor responses (SI) to KLH are shown for two independent tests. Test 1 was performed on freshly isolated PBMC and ANG01 is the re-test in the current study. Responses that did not produce the same result (i.e., positive or negative) in both tests are highlighted in bold italics. Three donors with very low basal cpm (<150 cpm) were excluded from the analysis.

EPISCREEN® Analysis: Proliferation Assays

EPISCREEN® was used to test overlapping peptides derived from the sequence of DT 1-389 including the DT C and I domains with 10 amino acids of human IL-2 at the C terminus. Overlapping peptides were designed spanning residues 1-389 of DT-1 together with 10 amino acids of human IL-2 at the C terminus (DT 1-389/IL-2 2-10). A series of 128×15mer peptides overlapping by 12 amino acids were synthesized together with 1×14mer and 1×11 mer and used to stimulate peripheral blood mononuclear cells (PBMC) derived from a cohort of 51 healthy donors using EPISCREEN® T cell epitope mapping. Individual peptides were tested in replicate cultures and responses were assessed using T cell proliferation assays to identify the precise location of epitopes. PBMC from each donor were thawed, counted and assessed for viability. Cells were revived in room temperature AIM V culture medium (Invitrogen, Carlsbad, Calif.) before adjusting the cell density to 2.5× $10^6$ PBMC/ml (proliferation cell stock). Peptides were dissolved in DMSO (Sigma-Aldrich, St Louis, Mo., USA) to a final concentration of 10 mM. Peptide culture stocks were then prepared by diluting into AIM V culture medium to a final concentration of 5 μM. For each peptide and each donor, sextuplicate cultures were established by adding 100 μl of the peptide culture stocks to 100 μl of proliferation cell stock in a flat bottomed 96 well plate. Both positive and negative control cultures were also established in sextuplicate. A total of 9×96 well plates were used for each donor, and each plate was sufficient to test 15 peptides with one negative control (carrier alone) in sextuplicate. On the final plate, the positive control KLH was added.

Cultures were incubated for a total of 6 days before adding 0.5 μCi ³[H]-Thymidine (Perkin Elmer®, Waltham, Mass., USA) to each well. Cultures were incubated for a further 18 hours before harvesting onto filter mats using a TomTec Mach III cell harvester. Counts per minute (cpm) for each well were determined by Meltilex™ (Perkin Elmer®, Waltham, Mass., USA) scintillation counting on a Microplate Beta Counter (Perkin Elmer®, Waltham, Mass., USA) in paralux, low background counting mode.

For proliferation assays, an empirical threshold of a stimulation index (SI) equal to or greater than 2 (SI≥2) has been previously established whereby samples inducing proliferative responses above this threshold are deemed positive (where included, borderline SIs≥1.90 are highlighted). Extensive assay development and previous studies have shown that this is the minimum signal to noise threshold allowing maximum sensitivity without detecting large numbers of false positive responses. Positive responses are defined by the following statistical and empirical thresholds:
1. Significance ($p<0.05$) of the response by comparing cpm of test wells against medium control wells using unpaired two sample student's t-test.
2. Stimulation index greater than 2 (SI≥2), where SI=mean of test wells (cpm)/mean medium control wells (cpm).

In addition, intra-assay variation was assessed by calculating the coefficient of variance and standard deviation (SD) of the raw data from replicate cultures.

Proliferation assays were set up in sextuplicate cultures ("non adjusted data"). To ensure that intra assay variability was low, data was also analyzed after removing the maximum and minimum cpm values ("adjusted data") and the SI of donor responses were compared using both data sets. T cell epitopes were identified by calculating the average frequency of responses to all peptides in the study+2×SD (background response rate). Any peptide(s) that induced proliferation above this threshold was considered to contain a T cell epitope.

In Silico iTope™ Analysis of Peptides

The sequences of peptides that were positive in the proliferation assay were analyzed using Antitope's predictive iTope™ software. This software predicts favorable interactions between amino acid side chains of the peptide and specific binding pockets within the MHC class II binding groove. The location of key binding residues was determined by generating 10mer peptides that overlapped by one amino acid spanning the long peptide sequence. Each 10mer was tested against Antitope's database of MHC class II allotypes (32 total) and scored based on their fit and interactions with the MHC class II molecules. Peptides that produced a high binding score against a large number of alleles were considered to contain the core 9mer. Such testing provided a comprehensive T cell epitope analysis of DT 1-389/IL-2 2-10 including (a) a full T cell epitope map of DT 1-389/IL-2 2-10 DT 1-389/IL-2 2-10; (b) assessment of the potency of individual T cell epitopes and prioritization for removal from DT; and (c) assessment of T cell epitope association with MHC class II allotypes.

Identification of T Cell Epitopes

All one hundred thirty peptides identified using the EPISCREEN® Analysis described above were successfully synthesized for testing against 51 healthy donors (54 donors were originally selected, but donors 13, 20 and 38 were excluded from the analysis due to low basal cpm, i.e., below the cut off value of 150cpm). Positive responses were defined by donors that produced a significant ($p<0.05$) response with a SI≥2 to any given peptide. Borderline responses (a significant ($p<0.05$) response with an SI≥1.90) were also included. The outputs from non-adjusted and adjusted data analyses were compared to ensure that intra-assay variability was low and that positive responses were not the result of spurious proliferation in individual wells. The results from each analysis showed little difference between the methods; consequently, the T cell epitope map was compiled using the adjusted data analysis. T cell epitopes were identified by calculating the average frequency of the responses to all peptides in the study plus twice the standard deviation (termed 'background response rate'). This was calculated to be 5.6% and was the equivalent of inducing a positive response in three or more donors. Peptides inducing proliferative responses above this threshold were considered to contain a T cell epitope.

Table 3 provides a summary of the individual donor responses to each of the peptides. Nine peptides induced proliferative responses above the background response rate (peptides 2, 31, 35, 39, 40, 41, 42, 49, and 100) and were therefore considered to contain a T cell epitope. From these nine peptides, a total of seven T cell epitopes were identified within the DT-1 sequence and are discussed in further detail below.

TABLE 3

Summary of donor responses to individual peptides. Positive responses (SI >= 2 and p < 0.05) are indicated by the donor number and individual SIs are shown in brackets next to the corresponding donor. Borderline responses (SI >= 1.9 & p < 0.05) are indicated (*). The background response rate was 5.6% which was equivalent to 3 donors.

| Peptide | No. of Responses | Responding Donors | Sequence | SEQ ID NO |
|---|---|---|---|---|
| 1 | 1 | 42*(1.94) | MGADDVVDSSKSFVM | 158 |
| 2 | 3 | 30* (1.93), 36(2.13), 47(2.2) | DDVVDSSKSFVMENF | 159 |
| 3 | 1 | 36(2.02) | VDSSKSFVMENFSSY | 160 |
| 4 | | | SKSFVMENFSSYHGT | 290 |
| 5 | 1 | 1(2.2) | FVMENFSSYHGTKPG | 291 |
| 6 | | | ENFSSYHGTKPGYVD | 292 |
| 7 | | | SSYHGTKPGYVDSIQ | 293 |
| 8 | | | HGTKPGYVDSIQKGI | 294 |
| 9 | 1 | 47(2.03) | KPGYVDSIQKGIQKP | 295 |
| 10 | 2 | 36(2.07), 47(4.01) | YVDSIQKGIQKPKSG | 296 |
| 11 | 2 | 36* (1.99), 47(2.26) | SIQKGIQKPKSGTQG | 297 |
| 12 | 1 | 47(3.71) | KGIQKPKSGTQGNYD | 298 |
| 13 | 1 | 47(2.13) | QKPKSGTQGNYDDDW | 299 |
| 14 | | | KSGTQGNYDDDWKGF | 300 |

TABLE 3-continued

Summary of donor responses to individual peptides. Positive responses (SI >= 2 and p < 0.05) are indicated by the donor number and individual SIs are shown in brackets next to the corresponding donor. Borderline responses (SI >= 1.9 & p < 0.05) are indicated (*). The background response rate was 5.6% which was equivalent to 3 donors.

| Peptide | No. of Responses | Responding Donors | Sequence | SEQ ID NO |
|---|---|---|---|---|
| 15 | 1 | 47*(1.95) | TQGNYDDDWKGFYST | 301 |
| 16 | | | NYDDDWKGFYSTDNK | 302 |
| 17 | 1 | 36*(1.95) | DDWKGFYSTDNKYDA | 303 |
| 18 | | | KGFYSTDNKYDAAGY | 304 |
| 19 | | | YSTDNKYDAAGYSVD | 305 |
| 20 | | | DNKYDAAGYSVDNEN | 306 |
| 21 | | | YDAAGYSVDNENPLS | 307 |
| 22 | 1 | 6*(1.97) | AGYSVDNENPLSGKA | 308 |
| 23 | | | SVDNENPLSGKAGGV | 309 |
| 24 | 1 | 36(2.05) | NENPLSGKAGGVVKV | 310 |
| 25 | 2 | 21(2), 36(2.11) | PLSGKAGGVVKVTYP | 311 |
| 26 | 1 | 35(2.11) | GKAGGVVKVTYPGLT | 312 |
| 27 | | | GGVVKVTYPGLTKVL | 313 |
| 28 | | | VKVTYPGLTKVLALK | 314 |
| 29 | | | TYPGLTKVLALKVDN | 315 |
| 30 | | | GLTKVLALKVDNAET | 316 |
| 31 | 4 | 12(2.23), 23(2.01), 30(2.04), 36(2.12) | KVLALKVDNAETIKK | 162 |
| 32 | 2 | 23*(1.90), 50*(1.92) | ALKVDNAETIKKELG | 163 |
| 33 | 2 | 36*(1.94), 46(2.01) | VDNAETIKKELGLSL | 317 |
| 34 | 1 | 47(2.22) | AETIKKELGLSLTEP | 318 |
| 35 | 3 | 1(4.29), 2(2.88), 35(2.23) | IKKELGLSLTEPLME | 166 |
| 36 | | | ELGLSLTEPLMEQVG | 319 |
| 37 | | | LSLTEPLMEQVGTEE | 320 |
| 38 | | | TEPLMEQVGTEEFIK | 321 |
| 39 | 3 | 5(2.26), 15(2.01), 50*(1.94) | LMEQVGTEEFIKRFG | 168 |
| 40 | 6 | 15(2.0), 36(2.45), 46*(1.90), 47(2.48), 49(2.19), 50(2.06) | QVGTEEFIKRFGDGA | 170 |
| 41 | 6 | 35*(1.99), 36(2.21), 40*(1.93), 46*(1.92), 49(3.12), 50(2.06) | TEEFIKRFGDGASRV | 171 |
| 42 | 6 | 35(2.11), 36(2.53), 40(2.17), 47(5.09), 49(4.72), 50(2.04) | FIKRFGDGASRVVLS | 172 |
| 43 | 2 | 4(6.71), 49(3.37) | RFGDGASRVVLSLPF | 322 |
| 44 | | | DGASRVVLSLPFAEG | 323 |
| 45 | | | SRVVLSLPFAEGSSS | 324 |
| 46 | | | VLSLPFAEGSSSVEY | 325 |
| 47 | 2 | 30(2.05), | LPFAEGSSSVEYINN | 326 |
| 48 | | 46*(1.92) | AEGSSSVEYINNWEQ | 327 |
| 49 | 3 | 30(2.27), 39(2.01), 49(3.10) | SSSVEYINNWEQAKA | 174 |
| 50 | 1 | 23*(1.91) | VEYINNWEQAKALSV | 328 |
| 51 | | | INNWEQAKALSVELE | 329 |
| 52 | 1 | 44*(1.92) | WEQAKALSVELEINF | 330 |
| 53 | | | AKALSVELEINFETR | 331 |
| 54 | 1 | 48*(1.99) | LSVELEINFETRGKR | 332 |
| 55 | 1 | 46(2.01) | ELEINFETRGKRGQD | 333 |
| 56 | 1 | 46*(1.94) | INFETRGKRGQDAMY | 334 |
| 57 | | | ETRGKRGQDAMYEYM | 335 |
| 58 | | | GKRGQDAMYEYMAQA | 336 |
| 59 | | | GQDAMYEYMAQACAG | 337 |
| 60 | | | AMYEYMAQACAGNRV | 338 |
| 61 | 1 | 47(4.13) | EYMAQACAGNRVRRS | 339 |
| 62 | 2 | 23(2.00), 47(3.38) | AQACAGNRVRRSVGS | 340 |
| 63 | | | CAGNRVRRSVGSSLS | 341 |

TABLE 3-continued

Summary of donor responses to individual peptides. Positive responses (SI >= 2 and p < 0.05) are indicated by the donor number and individual SIs are shown in brackets next to the corresponding donor. Borderline responses (SI >= 1.9 & p < 0.05) are indicated (*). The background response rate was 5.6% which was equivalent to 3 donors.

| Peptide | No. of Responses | Responding Donors | Sequence | SEQ ID NO |
|---|---|---|---|---|
| 64 | | | NRVRRSVGSSLSCIN | 342 |
| 65 | | | RRSVGSSLSCINLDW | 343 |
| 66 | | | VGSSLSCINLDWDVI | 344 |
| 67 | | | SLSCINLDWDVIRDK | 345 |
| 68 | | | CINLDWDVIRDKTKT | 346 |
| 69 | | | LDWDVIRDKTKTKIE | 347 |
| 70 | 1 | 8(2.11) | DVIRDKTKTKIESLK | 348 |
| 71 | 1 | 35*(1.90) | RDKTKTKIESLKEHG | 349 |
| 72 | | | TKTKIESLKEHGPIK | 350 |
| 73 | | | KIESLKEHGPIKNKM | 351 |
| 74 | | | SLKEHGPIKNKMSES | 352 |
| 75 | | | EHGPIKNKMSESPNK | 353 |
| 76 | 2 | 35(2.09), 48*(1.92) | PIKNKMSESPNKTVS | 354 |
| 77 | 2 | 30*(1.94), 35(2.08) | NKMSESPNKTVSEEK | 355 |
| 78 | 1 | 35(2.15) | SESPNKTVSEEKAKQ | 356 |
| 79 | 1 | 35*(1.91) | PNKTVSEEKAKQYLE | 357 |
| 80 | | | TVSEEKAKQYLEEFH | 358 |
| 81 | | | EEKAKQYLEEFHQTA | 359 |
| 82 | | | AKQYLEEFHQTALEH | 360 |
| 83 | | | YLEEFHQTALEHPEL | 361 |
| 84 | 2 | 35(2.12), 48(2.31) | EFHQTALEHPELSEL | 362 |
| 85 | 2 | 15(2.07), 35(2.1) | QTALEHPELSELKTV | 363 |
| 86 | 1 | 35(2.36) | LEHPELSELKTVTGT | 364 |
| 87 | 1 | 35(2.32) | PELSELKTVTGTNPV | 365 |
| 88 | 2 | 16(2.22), 35(2.1) | SELKTVTGTNPVFAG | 366 |
| 89 | 1 | 35*(1.92) | KTVTGTNPVFAGANY | 367 |
| 90 | | | TGTNPVFAGANYAAW | 368 |
| 91 | | | NPVFAGANYAAWAVN | 369 |
| 92 | 1 | 35(2.6) | FAGANYAAWAVNVAQ | 370 |
| 93 | | | ANYAAWAVNVAQVID | 371 |
| 94 | 2 | 23(2.36), 35(2.02) | AAWAVNVAQVIDSET | 372 |
| 95 | | | AVNVAQVIDSETADN | 373 |
| 96 | 1 | 2(3.86) | VAQVIDSETADNLEK | 374 |
| 97 | | | VIDSETADNLEKTTA | 375 |
| 98 | | | SETADNLEKTTAALS | 376 |
| 99 | | | ADNLEKTTAALSILP | 377 |
| 100 | 4 | 1(2.2), 15*(1.95), 30(3.0), 35(2.07) | LEKTTAALSILPGIG | 177 |
| 101 | 1 | 32(2.15) | TTAALSILPGIGSVM | 378 |
| 102 | 1 | 32(2.21) | ALSILPGIGSVMGIA | 379 |
| 103 | | | ILPGIGSVMGIADGA | 380 |
| 104 | 1 | 32*(1.96) | GIGSVMGIADGAVHH | 381 |
| 105 | | | SVMGIADGAVHHNTE | 382 |
| 106 | | | GIADGAVHHNTEEIV | 383 |
| 107 | | | DGAVHHNTEEIVAQS | 384 |
| 108 | | | VHHNTEEIVAQSIAL | 385 |
| 109 | 1 | 2(4.64) | NTEEIVAQSIALSSL | 386 |
| 110 | 1 | 2(3.85) | EIVAQSIALSSLMVA | 387 |
| 111 | | | AQSIALSSLMVAQAI | 388 |
| 112 | | | IALSSLMVAQAIPLV | 389 |
| 113 | | | SSLMVAQAIPLVGEL | 390 |
| 114 | | | MVAQAIPLVGELVDI | 391 |
| 115 | 1 | 36*(1.97) | QAIPLVGELVDIGFA | 392 |
| 116 | 1 | 15(2.16) | PLVGELVDIGFAAYN | 393 |
| 117 | | | GELVDIGFAAYNFVE | 394 |
| 118 | | | VDIGFAAYNFVESII | 395 |
| 119 | 2 | 36*(1.93), 47(2.08) | GFAAYNFVESIINLF | 396 |
| 120 | | | AYNFVESIINLFQVV | 397 |
| 121 | 2 | 30*(1.99), 45(2.07) | FVESIINLFQVVHNS | 398 |
| 122 | 2 | 30(2.31), 45(2.09) | SIINLFQVVHNSYNR | 399 |

TABLE 3-continued

Summary of donor responses to individual peptides. Positive responses (SI >= 2 and p < 0.05) are indicated by the donor number and individual SIs are shown in brackets next to the corresponding donor. Borderline responses (SI >= 1.9 & p < 0.05) are indicated (*). The background response rate was 5.6% which was equivalent to 3 donors.

| Peptide | No. of Responses | Responding Donors | Sequence | SEQ ID NO |
|---|---|---|---|---|
| 123 | 1 | 35(2.05) | NLFQVVHNSYNRPAY | 400 |
| 124 | | | QVVHNSYNRPAYSPG | 401 |
| 125 | | | HNSYNRPAYSPGHKT | 402 |
| 126 | | | YNRPAYSPGHKTHAP | 403 |
| 127 | | | PAYSPGHKTHAPTSS | 404 |
| 128 | | | SPGHKTHAPTSSSTK | 405 |
| 129 | | | HKTHAPTSSSTKKT | 406 |
| 130 | 1 | 35*(1.97) | HAPTSSSTKKT | 407 |

T Cell Epitopes Identified Via EPISCREEN®

(a) Epitope 1—Peptide 2

Peptide 2 (DDVVDSSKSFVMENF; SEQ ID NO: 159) contains a T cell epitope as indicated in Table 2. A total of three donors (30, 36 and 47) responded to peptide 2 although the response of donor 30 was borderline (SI of 1.92). As discussed throughout the specification above, elimination of T-cell epitopes can be accomplished via modification of amino acids in the identified epitopes. Modification of amino acids in the epitope, such as the amino acid residues associated with binding the anchor pockets (p1 and p9) of the MHC class II binding cleft, can affect and/or prevent the successful presentation of the epitope on the MHC class II molecule (i.e., eliminate the epitope). Similarly, modification of amino acid residues associated with binding the interior pockets of the MHC class II binding cleft, and/or residues outside the core 9-mer epitope that affect or interact with the MHC class II molecule can eliminate the epitope. Various combinations of amino acid residue modifications for the elimination of T-cell epitopes can be made and tested by the methods described herein.

Using Antitope's in silico iTope™ MHC class II predictive software, peptide 2 was analyzed for potential 9mer MHC class II binding registers. This software predicts the most favorable binding register for epitopes based on the number of alleles which have the potential to bind (from a total of 32) together with the mean binding score of the alleles (where the positive threshold is set at 0.5). The results of this analysis indicated that the core 9mer is VDSSKSFVM (SEQ ID NO: 161) with a valine (V8) as the potential p1 anchor residue (data not shown). In this conformation, the analysis predicted the binding of 25 out of 32 alleles. The VDSSKSFVM core 9mer (SEQ ID NO: 161) is also present in both peptides 1 and 3 which are overlapping with peptide 2. Interestingly, donor 36 responded to both peptides 2 and 3, (SIs of 2.13 and 2.02, respectively) and also had a high response to peptide 1 (SI=1.88) which was statistically significant (p<0.05), indicating that VDSSKSFVM (SEQ ID NO: 161) is the core 9mer binding register. Similarly, donor 30 responded to peptide 1 with an SI of 1.64 which was clearly below the cut off of 1.9-2.0 but was statistically significant (p<0.05) and higher than the overall background SI. Donor 47 did not mount positive responses to peptides 1 and 3. This is presumably due to the location of the core 9mer within the peptide; it is well documented that the interaction of residues outside of the 9mer binding register support the stability of the peptide:MHC class II complex (Engelhard et al 1994). It is therefore likely that peptide 2 contains the core 9mer in an optimal configuration for MHC class II binding. Inspection of the DT-1 crystal structure (Steere et at 2000) revealed that the p1 valine residue (V8) is in a partially exposed position; therefore polar replacement residues can be selected such that the polar moiety is surface exposed and the hydrophobic region is buried. Such modifications to the T-cell epitope can reduce immunogenicity of the toxin.

(b) Epitope 2—Peptide 31

Table 3 shows that 4 donors (donors 12, 23, 30 and 36) responded to peptide 31 (KVLALKVDNAETIKK; SEQ ID NO: 162) indicating the presence of a T cell epitope in this region. Furthermore, analysis of overlapping peptides showed that donor 23 produced a borderline response to peptide 32, and donor 36 also responded to peptide 32 with a response that was sub-threshold (SI=1.81) but statistically significant (p<0.05). Using iTope™ in silico analysis, the core 9mer for this peptide was predicted to be VDNAETIK (residues 1-8 of SEQ ID NO: 164) with a valine (V97) as the primary p1 anchor residue (data not shown). This was supported by the response of donor 23 to peptide 32, and the sub-threshold response of donor 36 to peptide 32 which also contained the same core 9mer (data not shown). In this conformation, the analysis indicated the binding of 28 out of 32 MHC class II alleles. Structure and homology modeling revealed the location of V97 to be well exposed on the surface of the molecule and not associated with the active site.

(c) Epitope 3—Peptide 35

Peptide 35 (SEQ ID NO: 166) contains a T cell epitope as indicated by three donors (donors 1, 2 and 35) which produced positive proliferation responses following stimulation as described above (data not shown and Table 3). Analysis by iTope™ revealed that the most favorable binding register for this peptide was LGLSLTEPL (SEQ ID NO: 167) with a leucine (L107) as the primary anchor residue, p1 (data not shown). This 9mer had the potential to bind 13 out of 32 MHC class II alleles. Donor 35 also had a proliferative response (SI=1.83) to peptide 34 which contained the same core 9mer. This was below the 1.9-2.0 cut off for a positive response but was statistically significant (p<0.05) and indicates that the sequence LGLSLTEPL (SEQ ID NO: 167) is the epitope within this region.

Crystal structure analysis and homology modeling of the p1 anchor for this epitope indicates it is mostly buried, with a small amount of surface exposure. As for epitope 1, it would be possible to substitute polar residues to remove binding to MHC class II. The p9 anchor of this peptide is also buried; therefore changes are considered at other pocket positions including p6 and p7 which are well exposed on the surface of the toxin.

(d) Epitope 4—Peptide 39

Three donors (donors 5, 15 and 50) produced positive proliferative responses following stimulation with peptide 39 (LMEQVGTEEFIKRFG; SEQ ID NO: 168) although the response of donor 50 was borderline (SI of 1.94) (data not shown and Table 3). The T cell epitope within this peptide was predicted after iTope™ analysis to contain MEQVGTEEF (SEQ ID NO: 169) as a core 9mer MHC class II binding register (data not shown). In this conformation, a methionine at position 116 forms the p1 anchor residue and this epitope is predicted to bind 19 out of 32 MHC class II alleles. Positions 1 and 9 of this MHC class II binding register are buried in the core of the catalytic domain of the toxin, and are packed against each other. These residues are therefore considered important for the overall stability of the protein. Similar to epitope 3, residues that interact with other pockets in the core 9mer, such as p6 and p7 (which are well exposed), are considered for substitution.

(e) Epitope 5—Peptides 40, 41 and 42.

A potent T cell epitope appears to lie within peptides 40, 41 and 42 (SEQ ID NOS: 170-172). Of all the epitopes detected, the epitope in this region is the most immunogenic, as shown by its ability to induce responses in a total of 8 different donors, representing 15.7% of the study cohort (Table 3 and data not shown). Six donors responded to peptides 40 (donors 15, 36, 46, 47, 49 and 50), peptide 41 (donors 35, 36, 40, 46, 49, 50) and 42 (donors 35, 36, 40, 47, 49 50), and responses to all 3 overlapping peptides were observed for donors 49 and 50 while donors 30, 40, 46 and 47 responded to two overlapping peptides. iTope™ in silico analysis predicted the binding motif for this peptide to be FIKRFGDGA (SEQ ID NO: 173) with a phenylalanine (F124) as the p1 anchor residue (data not shown). This 9mer was present in all three overlapping peptides and was predicted to bind 23 out of 32 MHC class II alleles. Phenylalanine 124 is substantially buried within the core of the catalytic domain and packs against M115 and V118 and is therefore considered to be potentially structurally important. However anchor positions 4, 6, 7 and 9 are exposed to varying degrees and can be targeted to remove the epitope.

(f) Epitope 6—Peptide 49.

Peptide 49 (SSSVEYINNWEQAKA; SEQ ID NO: 174) also contains a T cell epitope. Table 3 shows that three donors (donors 30, 39 and 49) produced positive proliferative responses following stimulation with peptide 49. Using iTope™ in silico analysis, the most favorable binding register for this peptide was predicted to be VEYINNWEQ (SEQ ID NO: 175; data not shown) which had the potential to bind 22 out of 32 MHC class II alleles. This binding register had a valine (V148) as the p1 anchor residue. While peptides 48 and 50, which overlapped with peptide 49, also contained the same core 9mer, donors 30, 39 and 49 did not respond to the overlapping peptides, demonstrating that residues outside the core 9mer are also important in the binding of the peptide to the MHC class II molecule. Valine 148 is partially surface exposed; therefore polar replacement residues can be selected such that the hydrophilic moiety is surface exposed and the hydrophobic region is buried.

(g) Epitope 7—Peptide 100.

Epitope 7 was found within peptide 100 (LEKTTAALSILPGIG; SEQ ID NO: 177). Four donors (donors 1, 15, 30 and 35) responded to peptide 100, and the response of donor 15 was borderline. iTope™ analysis predicted the core 9mer binding register for this peptide to be LEKTTAALS (SEQ ID NO: 178) with a leucine (L298) as the p1 anchor residue (data not shown). This 9mer was predicted to bind 24 out of 32 possible MHC class II alleles. The 9mer was also present within peptide 99, to which donor 30 mounted a statistically significant (p<0.05) sub-threshold response (SI=1.84) thus supporting LEKTTAALS (SEQ ID NO: 178) as the binding motif for these peptides. Leucine 298 lies well exposed on the surface of the translocation domain and is not associated with the activity of this domain. It therefore poses no apparent problems for replacement. Thus, the residue can be readily replaced in order to modify/eliminate the T-cell epitope.

T Cell Epitopes and Allotype Responses

Table 4 summarizes the details of the seven T cell epitopes found within the DT-1 sequence. No epitopes were detected within the junction between DT-1 and IL-2.

The T cell epitope located in peptide 40, 41 and 42 (epitope 5) induced responses in 15.7% of the cohort. Epitopes located within peptides 31 and 100 (epitopes 2 and 7, respectively) induced responses in 7.84% of the study cohort (Table 4). The epitopes within peptides 2 (epitope 1), 35 (epitope 3), 39 (epitope 4) and 49 (epitope 6) induced responses in 5.88% of the cohort. Analysis of the magnitude (mean SI) of positive responses to each of the epitopes showed that all appeared to be fairly equal in their potency with average SIs of 2-2.5. Epitope 3 however had a larger mean SI of 3.13.

TABLE 4

Summary of the magnitude and frequency of positive responses to peptides containing T cell epitopes.

| Epitope | Peptide(s) | Donors Responding | Mean SI +/− SD | % response |
|---|---|---|---|---|
| epitope 1 | 2 | 30, 36, 47 | 2.09 (+/−0.14) | 5.9 |
| epitope 2 | 31 | 12, 23, 30, 36 | 2.10 (+/−0.10) | 7.8 |
| epitope 3 | 35 | 1, 2, 35 | 3.13 (+/−1.05) | 5.9 |
| epitope 4 | 39 | 5, 15, 50 | 2.07 (+/−2.18) | 5.9 |
| epitope 5 | 40 | 15, 36, 46, 47, 49, 50 | 2.18 (+/−0.24) | 15.7 |
|  | 41 | 35, 36, 40, 46, 49, 50 | 2.21 (+/−0.46) |  |
|  | 42 | 35, 36, 40, 46, 49, 50 | 3.11 (+/−1.41) |  |
| epitope 6 | 49 | 30, 39, 49 | 2.46 (+/−0.57) | 5.9 |
| epitope 7 | 100 | 1, 15, 30, 35 | 2.31 (+/−0.47) | 7.8 |

Associations between the expression of HLA-DR allotypes and donors responding to individual peptides were also analyzed. Epitopes 2, 5 and 7 (peptides 31, 40-42 and 100) were assessed. Table 4 shows the frequency of allotypes expressed by donors responding to each of the peptides compared with the frequency of allotypes expressed in the ANG01 study cohort. An association between MHC class II allotype and a response to a particular epitope was considered if the frequency of the allotype within the responding population was more than double the observed frequency (i.e., the frequency in the study population×2).

A comparison of positive donor responses observed in the EPISCREEN® assay against MHC class II allotypes expressed by individual donors indicated that responding donors to epitopes 2, 5 and 7 are associated with particular allotypes. T cell responses to epitope 5 were associated with the expression of HLA-DRB1*11, HLA-DRB1*15 and HLA-DR5. The frequencies of donors responding to this epitope and expressing these allotypes were 12%, 15%, and 15%, respectively. All of these were more than double the frequencies of these allotypes within the ANG01 study cohort, which were 5%, 7% and 7% respectively. In addition, iTope™ analysis of the peptide showed that HLA-DR5 would bind the predicted core 9mer. T cell responses to epitopes 2 and 7 both appeared to be associated with HLA-DRB1*15 and HLA-DRB5. The frequency of donors responding to epitope 2 or epitope 7 and expressing HLA-DRB1*15 and HLA-DRB5 was 20% and 21% for each respective allele which was more than double the observed frequency of 7% for each allele in the ANG01 study cohort. iTope™ analysis of these peptides showed the predicted binding register for each peptide had the potential to bind HLA-DR5. In addition to identification of T cell epitopes, these analyses also indicate an association of T cell responses to a particular peptide with the expression of MHC class II alleles.

FIG. 18 provides a graph of the scatter data presented in FIG. 19.

(c) Cell Membrane Integrity

TABLE 5

Frequency (shown as percentages) of responding donor allotypes compared to the frequency of allotypes expressed within the study population. Associations between an MHC class II allotype and a response to an epitope are highlighted in gray.

| Frequency (%) of HLA alleles expressed within | DRB1* 01 | DRB1* 03 | DRB1* 04 | DRB1* 07 | DRB1* 11 | DRB1* 13 | DRB1* 15 | DRB3 | DRB4 | DRB5 |
|---|---|---|---|---|---|---|---|---|---|---|
| Study population | 6 | 9 | 10 | 7 | 5 | 7 | 7 | 20 | 17 | 7 |
| Responders to epitope 2 | 0 | 7 | 7 | 13 | 0 | 0 | 20 | 7 | 20 | 20 |
| Responders to epitope 5 | 3 | 3 | 9 | 0 | 12 | 3 | 15 | 18 | 12 | 15 |
| Responders to epitope 7 | 7 | 7 | 14 | 0 | 0 | 0 | 21 | 7 | 14 | 21 |

Example 10

VLS Assays

Various assays can be used to assess VLS activity of DT variants as described herein.

In one assay, DT-IL2 or variants are conjugated to fluorescein. Fluorescence microscopy/manual counting of labeled cells can be used to assess direct binding to HUVEC cells as surrogate for VLS activity.

In vivo studies; morphological changes; c (a) In Vitro Transcription-Translation (IVTT) Assay Using an in vitro transcription-translation (IVTT) assay to measure DT activity, direct transcription/translation of DT genes was tested using a rabbit reticulocyte lysate system. Typically this involves coupled transcription/translation of a luciferase gene with a chemiluminescent assay which measures IVTT of target plasmid (T7-luciferase)-active toxin inhibits and reduces luciferase signal. PCR products are utilized allowing medium throughput screening (MTS) with a titration curve and all variants are compared to WT DT in the same 96-well assay plate. A surrogate $IC_{50}$ can be determined from an inhibition curve. Since DT binds and causes the covalent modification of elongation factor-2 (EF-2), this should cause an inhibition of luciferase production for active DT variants. Coupled transcription/translation assays can be used for analysis of ribosome-inhibitory proteins to provide information on activity of the C domain of DT. Various methods are known to those of skill in the art that are useful in carrying out such coupled transcription/translation assays reactions such as, for example, described in U.S. Pat. Nos. 5,976,806 and 5,695,983, each of which is hereby incorporated by reference in its entirety.

Using the IVTT assay described herein, it was shown that WT DR DT demonstrated dose-dependant inhibition of transcription/translation of T7-luc plasmid approaching 90% while the null plateaued at approximately 20% inhibition (data not shown).

Additional mutants have been tested using the IVTT assay described herein.

Figure 14:
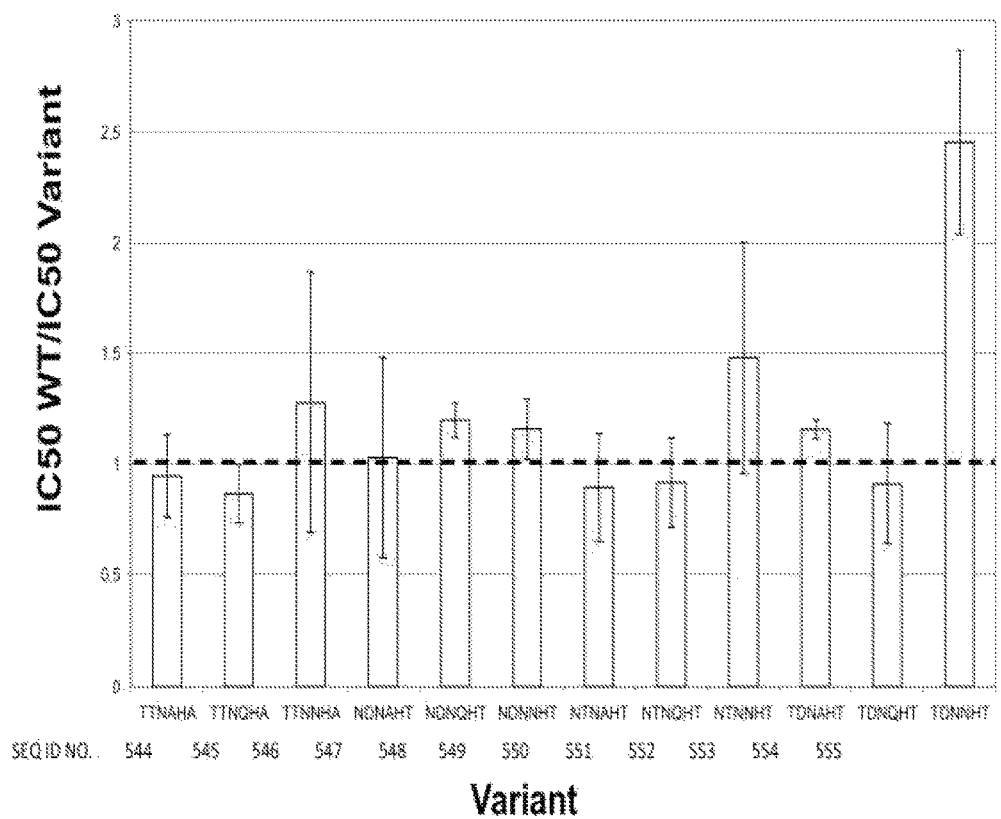
FIG. 14. Provides IVTT assays demonstrating that DT toxins containing six modifications are active. Constructs are as follows.

FIG. 14 illustrates IVTT assays demonstrating that DT toxins containing six modifications are active.

FIG. 15 illustrates IVTT assays demonstrating that DT toxins containing seven modifications are active.

(b) Luminescent Cytotoxicity Assay

Toxilight™, Vialight™ and ALAMARBLUE™ kits are non-radioactive, commercial assays which can be used to measure cytotoxicity. The assays are conducted in a 96-well plate format, titrating toxin ($10^{-7}$-$10^{-12}$ M) over time using susceptible and resistant cell lines.

VLS Modified Toxins

Cytotoxicity of wild type DT, a negative control, and a number of variants were assessed using the Toxilight™ kit.

Cytotoxicity of ONTAK® vs. IL-2 to human T cell lines was assessed using the Toxilight™ kit at 48 hours; luminescence counts per second (LCPS) reflect the degree of adenylate kinase release (data not shown).

Figure 1:
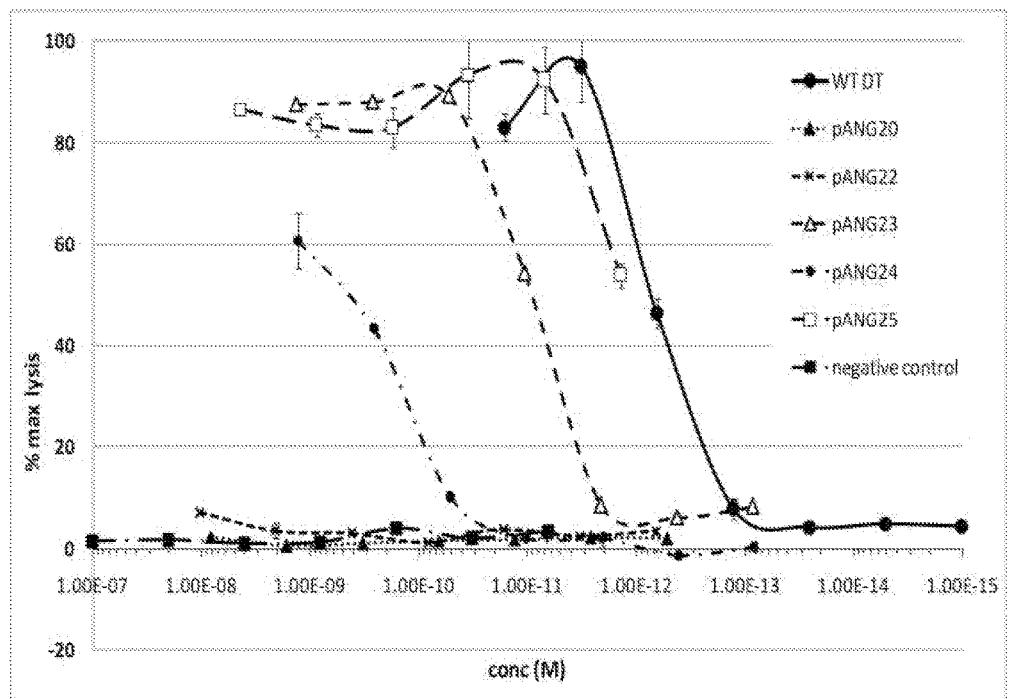
FIG. 1. Provides the % maximum lysis of a variety of DT toxins that have been modified at VLS motifs compared to wild type DT and a negative control. Constructs are as follows: pANG 19=V7N V29N I290N; pANG 20=V7N V29N S292A; pANG 21=V7N V29N S292T; pANG 22=V7N V29T S292A; pANG 23=V7N V29T I290T; pANG 24=V7N V29T I290N; and pANG 25=V7N.

FIG. 1 illustrates the % maximum lysis of a variety of DT toxins that have been modified at VLS motifs compared to wild type DT and a negative control. Constructs are as follows: pANG 19=V7N V29N I290N; pANG 20=V7N V29N S292A; pANG 21=V7N V29N S292T; pANG 22=V7N V29T S292A; pANG 23=V7N V29T I290T; pANG 24=V7N V29T I290N; and pANG 25=V7N.

IC50s were determined for the constructs and the means are provided in the Table below.

| Calculated IC50 | | |
| --- | --- | --- |
| | $IC_{50}$ (M) | stdev |
| WTDT | 1.2E−12 | 7.6E−13 |
| pANG20 | 0.0E+00 | 0.0E+00 |
| pANG22 | 0.0E+00 | 0.0E+00 |
| pANG23 | 1.2E−11 | 1.8E−12 |

| Calculated IC50 | | |
| --- | --- | --- |
| | $IC_{50}$ (M) | stdev |
| pANG24 | 3.4E−09 | 4.2E−09 |
| pANG25 | 2.2E−13 | 6.1E−14 |
| Negative control | 0.0E+00 | 0.0E+00 |

Current mean IC50 values for WT and mutant DT; n=4 or more for each variant; and '0.0E+00'=not active below 1E−7M.

Figure 2:
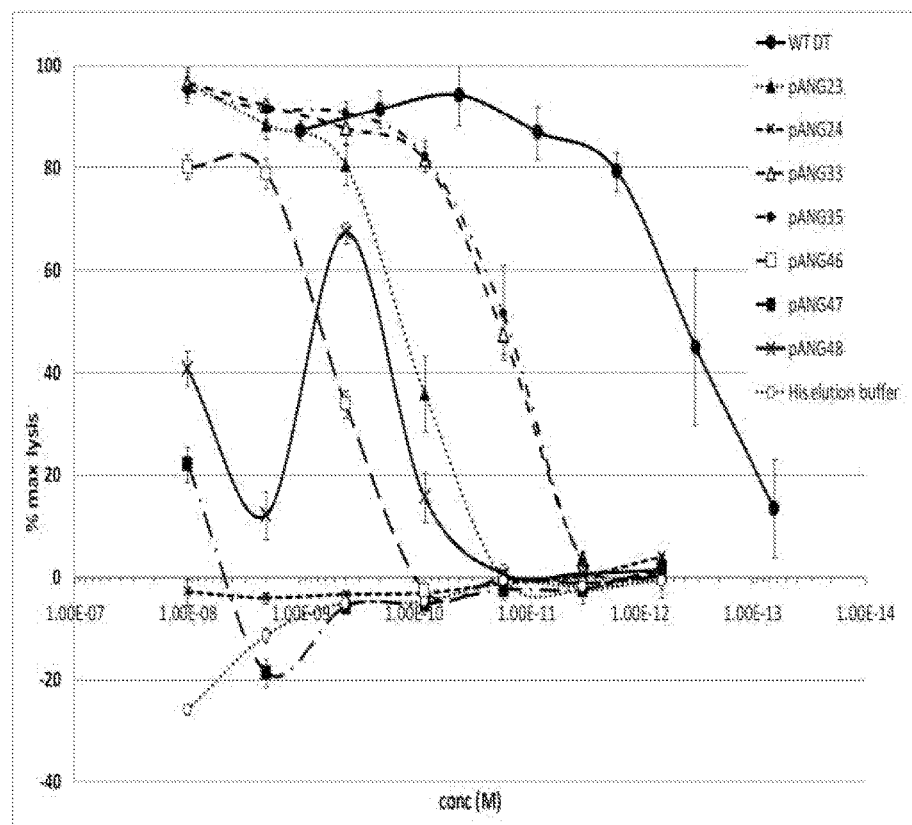
FIG. 2. Provides the % maximum lysis of a variety of DT toxins that have been modified at VLS motifs compared to wild type DT and a negative control (His elution buffer). Constructs are as follows: pANG23—V7N V29T I290T; pANG24—V7N V29T I290N; pANG33—V7N V29T; pANG35—V7N D30E I290T; pANG46—V7N D30E I290N; pANG47—V7N V29T D291K; and pANG48—V7N D30E D291K.

FIG. 2 illustrates the % maximum lysis of a variety of DT toxins that have been modified at VLS motifs compared to wild type DT and a negative control (His elution buffer). Constructs are as follows: pANG23—V7N V29T I290T; pANG24—V7N V29T I290N; pANG33—V7N V29T; pANG35—V7N D30E I290T; pANG46—V7N D30E I290N; pANG47—V7N V29T D291K; and pANG48—V7N D30E D291K.

Figure 3:
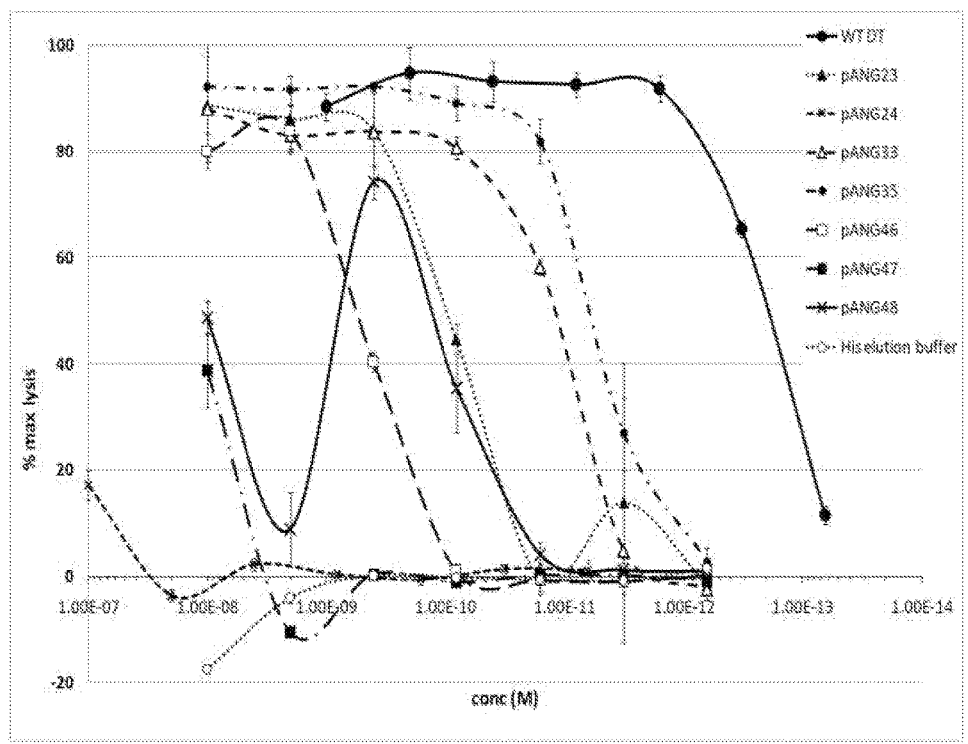
FIG. 3. Provides the % maximum lysis of a variety of DT toxins that have been modified at VLS motifs compared to wild type DT and a negative control (His elution buffer). Constructs are as follows: pANG23—V7N V29T I290T; pANG24—V7N V29T I290N; pANG33—V7N V29T; pANG35—V7N D30E I290T; pANG46—V7N D30E I290N; pANG47—V7N V29T D291K; and pANG48—V7N D30E D291K.

FIG. 3 illustrates another example of the % maximum lysis of a variety of DT toxins that have been modified at VLS motifs compared to wild type DT and a negative control (His elution buffer). Constructs are as follows: pANG23—V7N V29T I290T; pANG24—V7N V29T I290N; pANG33—V7N V29T; pANG35—V7N D30E I290T; pANG46—V7N D30E I290N; pANG47—V7N V29T D291K; and pANG48—V7N D30E D291K.

EC50s were determined for the constructs and the means are provided in the Table below.

| Plasmid | Variant | Mean EC50 (M) |
| --- | --- | --- |
| pANG11 | WT DT | 2.29E−13 |
| pANG23 | V7N V29T I290T | 9.81E−11 |
| pANG24 | V7N V29T I290N | 1.05E−06 |
| pANG33 | V7N V29T | 1.58E−11 |
| pANG35 | V7N D30E I290T | 1.09E−11 |
| pANG46 | V7N D30E I290N | 5.46E−10 |
| pANG47 | V7N V29T D291K | 1.95E−08 |
| pANG48 | V7N D30E D291K | 1.61E−10 |

Figure 4:
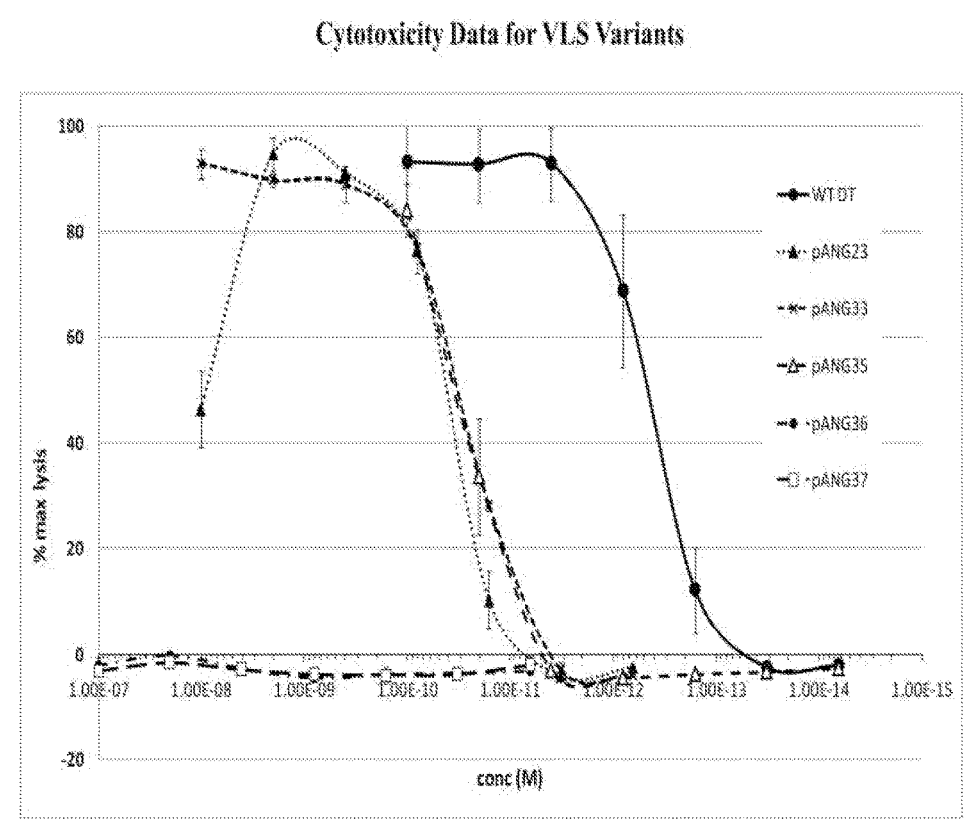

FIG. 4 illustrates another example of the % maximum lysis of a variety of DT toxins that have been modified at VLS motifs compared to wild type DT. Constructs are as follows: pANG23—V7N V29T I290T; pANG33—V7N V29T; pANG35—V7N D30E I290T; pANG36—V7N V29S I290T; and pANG37—V7N V29D I290T.

EC50s were determined for the constructs and the means are provided in the Table below.

| Calculated EC50s | | |
| --- | --- | --- |
| Plasmid | Variant | EC50 |
| pANG23 | V7N V29T I290T | 2.29E−11 |
| pANG33 | V7N V29T | 2.27E−11 |
| pANG35 | V7N D30E I290T | 2.56E−11 |
| pANG36 | V7N V29S I290T | 1.00E+00 |
| pANG37 | V7N V29D I290T | 1.00E+00 |

Figure 5:
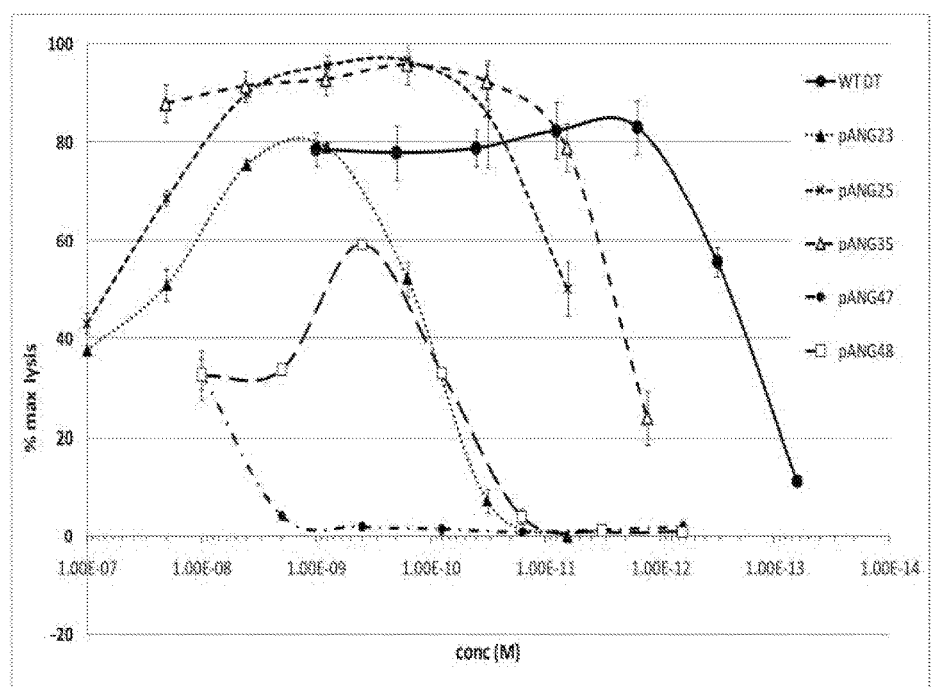
FIG. 5. Provides the % maximum lysis of a variety of DT toxins that have been modified at VLS motifs compared to wild type DT. Constructs are as follows: pANG23—V7N V29T I290T; pANG25—V7N; pANG35—V7N D30E I290T; pANG47—V7N V29T D291K; and pANG48—V7N D30E D291K.

FIG. 5 illustrates another example of the % maximum lysis of a variety of DT toxins that have been modified at VLS motifs compared to wild type DT. Constructs are as follows: pANG23—V7N V29T I290T; pANG25—V7N; pANG35—V7N D30E I290T; pANG47—V7N V29T D291K; and pANG48—V7N D30E D291K.

Figure 6:
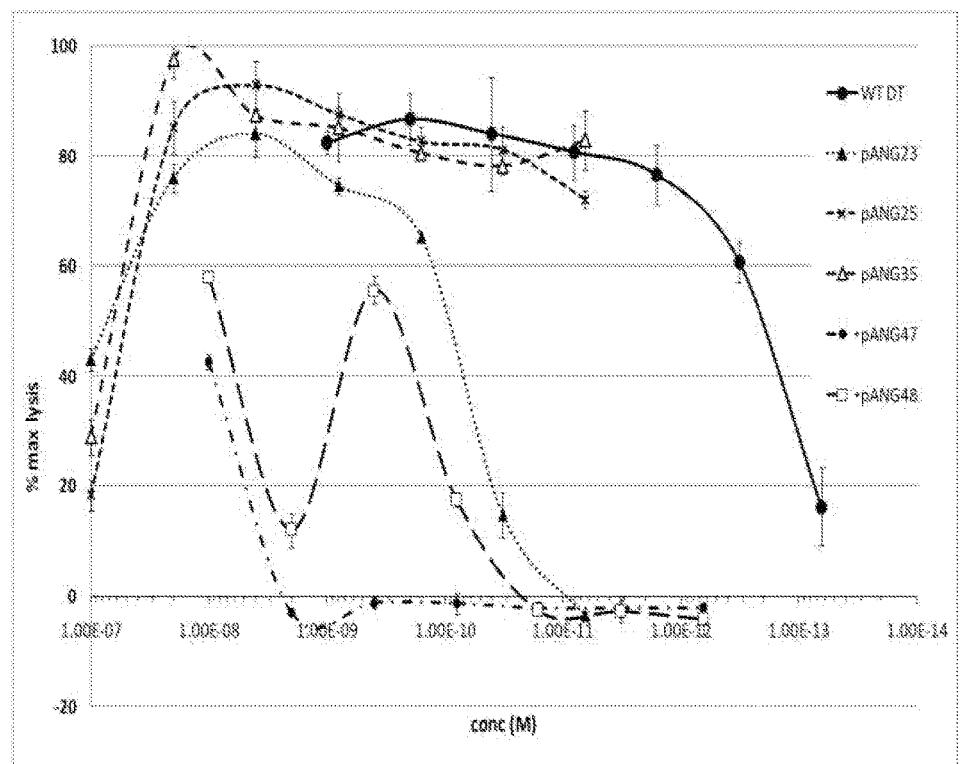
FIG. 6. Provides the % maximum lysis of a variety of DT toxins that have been modified at VLS motifs compared to wild type DT. Constructs are as follows: pANG23—V7N V29T I290T; pANG25—V7N; pANG35—V7N D30E I290T; pANG47—V7N V29T D291K; and pANG48—V7N D30E D291K.

FIG. 6 illustrates another example of the % maximum lysis of a variety of DT toxins that have been modified at VLS motifs compared to wild type DT. Constructs are as follows: pANG23—V7N V29T I290T; pANG25—V7N; pANG35—V7N D30E I290T; pANG47—V7N V29T D291K; and pANG48—V7N D30E D291K.

EC50s were determined for the constructs and the means are provided in the Table below.

| Plasmid | Variant | Mean |
| --- | --- | --- |
| pANG11 | WT DT | 7.6E–13* |
| pANG25 | V7N | 2.82E–12 |
| pANG23 | V7N V29T I290T | 1.2E–11* |
| pANG24 | V7N V29T I290N | 3.4E–9* |
| pANG35 | V7N D30E I290T | 1.34E–12 |
| pANG46 | V7N D30E I290N | ND |
| pANG47 | V7N V29T D291K | 1.13E–08 |
| pANG48 | V7N D30E D291K | 2.17E–10 |

*Average including data from previous experiments; ND = not determined.

A summary table of EC50s and binding to HUVEC cells by an exemplary number of VLS variants is provided in the table below.

| | | Summary Activity for VLS Mutants | | | |
| --- | --- | --- | --- | --- | --- |
| ΔR Clone No. | Full Length Clone No. | Mutations | IVTT Activity | HUVEC Binding | Cytotox Assay EC50 |
| 13 | 19 | V7N V29N 1290N | 1.70 | 91 | >1 × $10^{-8}$ |
| 14 | 20 | V7N V29N S292A | 1.25 | 100 | >1 × $10^{-8}$ |
| 15 | 21 | V7N V29N S292T | 1.08 | >100 | >1 × $10^{-8}$ |
| 16 | 22 | V7N V29N S292A | 1.07 | 27 | >1 × $10^{-8}$ |
| 17 | 23 | V7N V29T 1290T | 1.20 | >100 | 1.2 × $10^{-11}$ |
| 18 | 24 | V7N V29T 1290N | 1.38 | 36 | 3.4 × $10^{-9}$ |
| WT | — | — | 1.00 | 100 | 7.6 × $10^{-13}$ |
| — | 25 | V7N | 0.63 | ND | 2.2 × $10^{-13}$ |
| — | 32 | V7N V29N | 1.18 | ND | >1 × $10^{-8}$ |
| — | 33 | V7N V29T | 1.56 | ND | 2.1 × $10^{-11}$ |

T Cell Epitope Modified Toxins

T cell epitope variants have also been tested using the Toxilight™ assay described above.

Figure 7:
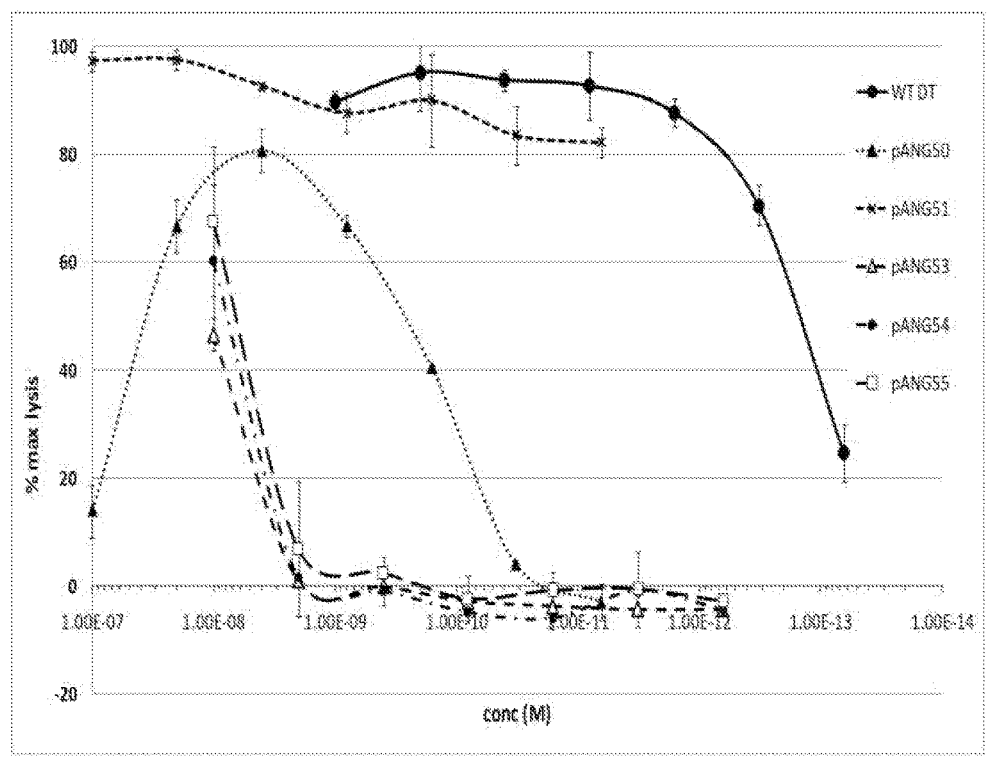
FIG. 7. Provides the % maximum lysis of a variety of DT toxins that have been modified at T cell epitopes compared to wild type DT. Constructs are as follows: pANG50—V7N V97A; pANG51—V7N V97T; pANG53—V7N L107A; pANG54—V7N L107N; and pANG55—V7N M116A.

FIG. 7 illustrates one example of the % maximum lysis of a variety of DT toxins that have been modified at T cell epitopes compared to wild type DT. Constructs are as follows: pANG50—V7N V97A; pANG51—V7N V97T; pANG53—V7N L107A; pANG54—V7N L107N; and pANG55—V7N M116A.

Figure 8:
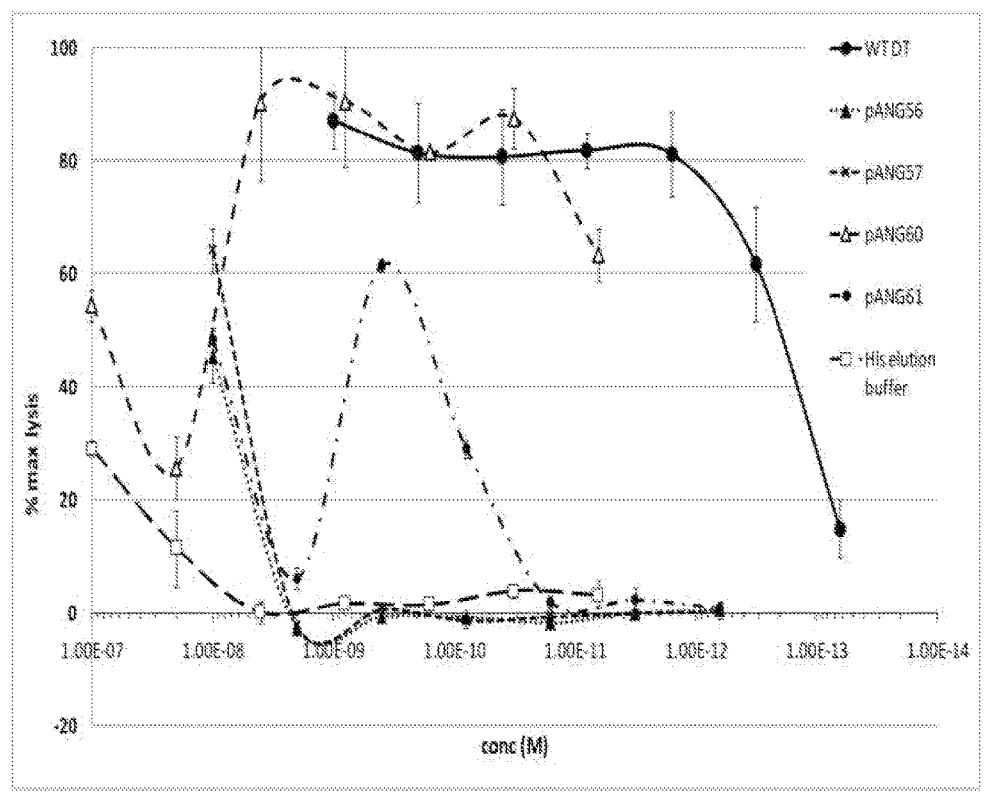
FIG. 8. Provides the % maximum lysis of a variety of DT toxins that have been modified at T cell epitopes compared to wild type DT. Constructs are as follows: pANG56—V7N M116N; pANG57—V7N M116Q; pANG60—V7N L298A; pANG61—V7N L298N.

FIG. 8 illustrates another example of the % maximum lysis of a variety of DT toxins that have been modified at T cell epitopes compared to wild type DT. Constructs are as follows: pANG56—V7N M116N; pANG57—V7N M116Q; pANG60—V7N L298A; pANG61—V7N L298N.

Figure 9:
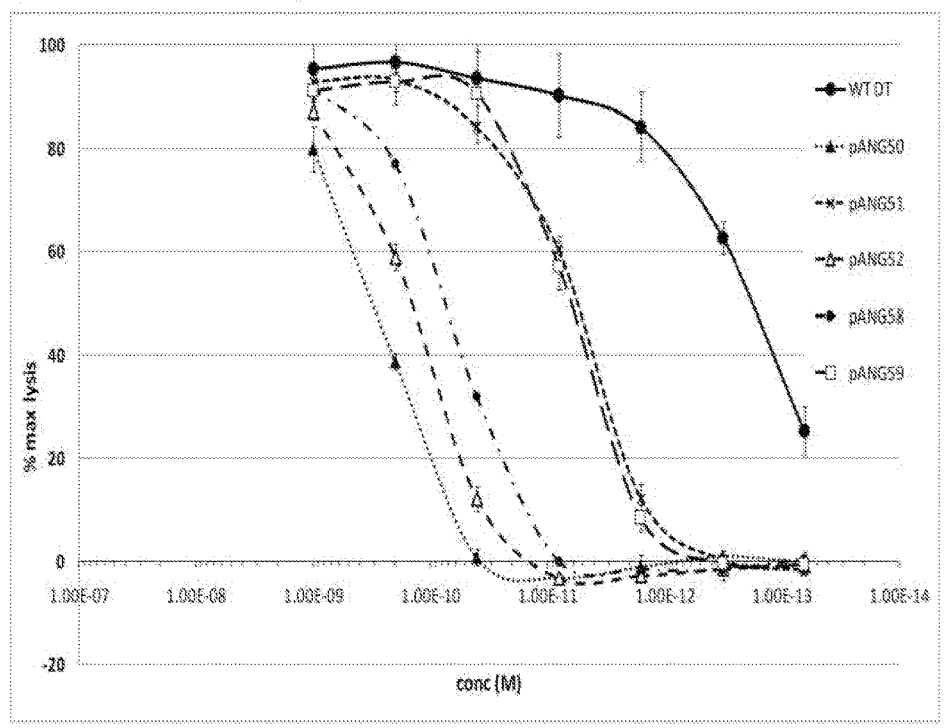
FIG. 9. Provides the % maximum lysis of a variety of DT toxins that have been modified at T cell epitopes compared to wild type DT. Constructs are as follows: pANG50—V7N V97A; pANG51—V7N V97T; pANG52—V7N V97D; pANG58—V7N V148A; and pANG59—V7N V148T.

FIG. 9 illustrates another example of the % maximum lysis of a variety of DT toxins that have been modified at T cell epitopes compared to wild type DT. Constructs are as follows: pANG50—V7N V97A; pANG51—V7N V97T; pANG52—V7N V97D; pANG58—V7N V148A; and pANG59—V7N V148T.

EC50s were determined for the constructs and the means are provided in the Table below.

| Epitopes | Plasmid | Variant | Mean EC50 (M) |
| --- | --- | --- | --- |
| | pANG11 | WT DT | 2.27E–13 |
| 1 + 2 | pANG50 | V7N V97A | 5.16E–10 |
| | pANG51 | V7N V97T | 4.65E–12 |
| | pANG52 | V7N V97D | 1.57E–10 |
| 1 + 3 | pANG53 | V7N L107A | 2.69E–08 |
| | pANG54 | V7N L107N | 6.89E–09 |
| 1 + 4 | pANG55 | V7N M116A | 6.74E–08 |
| | pANG56 | V7N M116N | 6.15E–08 |
| | pANG57 | V7N M116Q | 9.17E–09 |
| 1 + 6 | pANG58 | V7N V148A | 3.74E–11 |
| | pANG59 | V7N V148T | 6.54E–12 |
| 1 + 7 | pANG60 | V7N L298A | 3.58E–11 |
| | pANG61 | V7N L298N | 1.52E–10 |
| | Buffer control | | 2.59E–05 |

Figure 10:
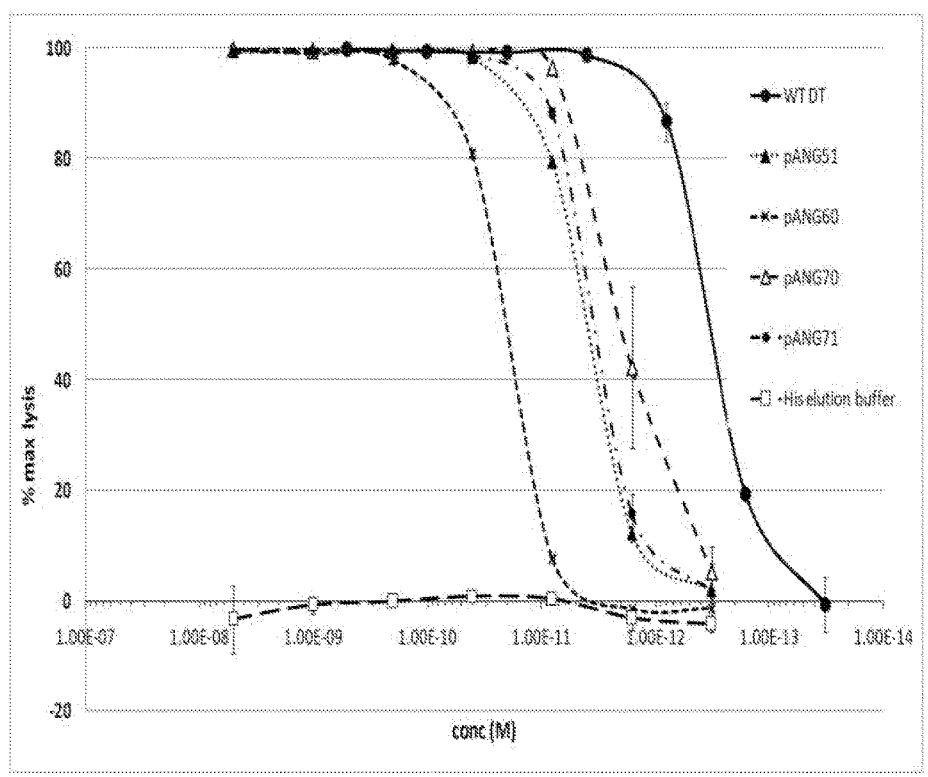
FIG. 10. Provides the % maximum lysis of a variety of DT toxins that have been modified at T cell epitopes compared to wild type DT and His elution buffer. Constructs are as follows: pANG51—V7N V97T; pANG60—V7N L298A; pANG70—V7N V97T L298A; and pANG71—V7N V97T L298N.

FIG. 10 illustrates another example of the % maximum lysis of a variety of DT toxins that have been modified at T cell epitopes compared to wild type DT and His elution buffer. Constructs are as follows: pANG51—V7N V97T; pANG60—V7N L298A; pANG70—V7N V97T L298A; and pANG71—V7N V97T L298N.

Figure 11:
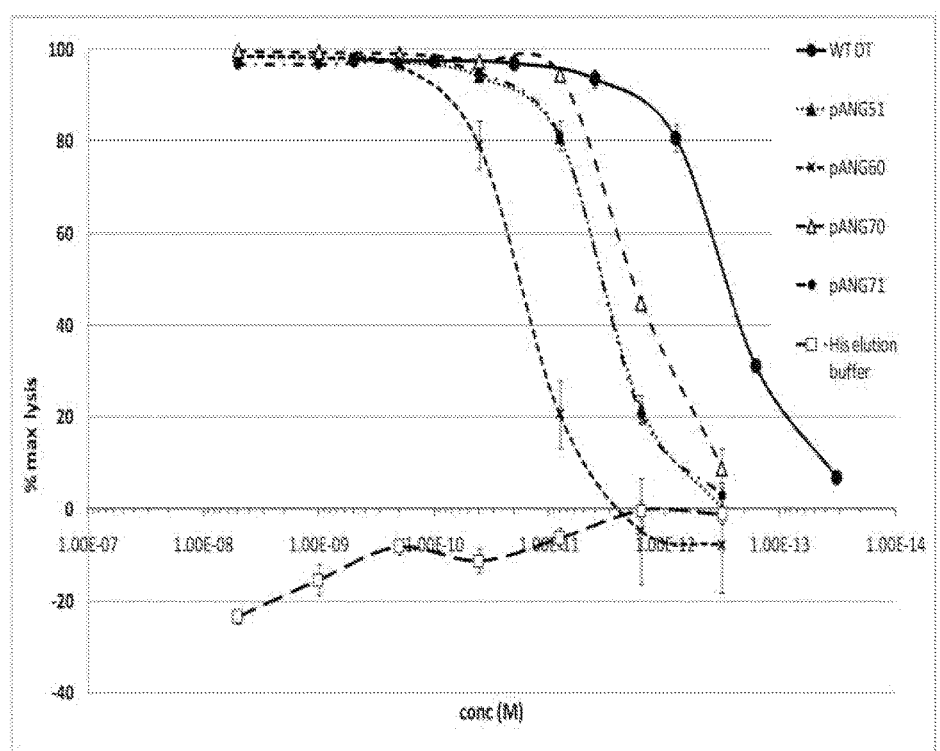
FIG. 11. Provides the % maximum lysis of a variety of DT toxins that have been modified at T cell epitopes compared to wild type DT and His elution buffer. Constructs are as follows: pANG51—V7N V97T; pANG60—V7N L298A; pANG70—V7N V97T L298A; and pANG71—V7N V97T L298N.

FIG. 11 illustrates another example of the % maximum lysis of a variety of DT toxins that have been modified at T cell epitopes compared to wild type DT and His elution buffer. Constructs are as follows: pANG51—V7N V97T; pANG60—V7N L298A; pANG70—V7N V97T L298A; and pANG71—V7N V97T L298N.

EC50s were determined for the constructs and the means are provided in the Table below.

| Calculated EC50 | | |
| --- | --- | --- |
| Plasmid | Variant | Average EC50 (M) |
| pANG11 | WT DT | 2.81E–13 |
| pANG51 | V7N V97T | 2.11E–12 |
| pANG60 | V7N L298A | 1.86E–11 |
| pANG70 | V7N V97T L298A | 1.59E–12 |
| pANG71 | V7N V97T L298N | 3.37E–12 |

Figure 12:
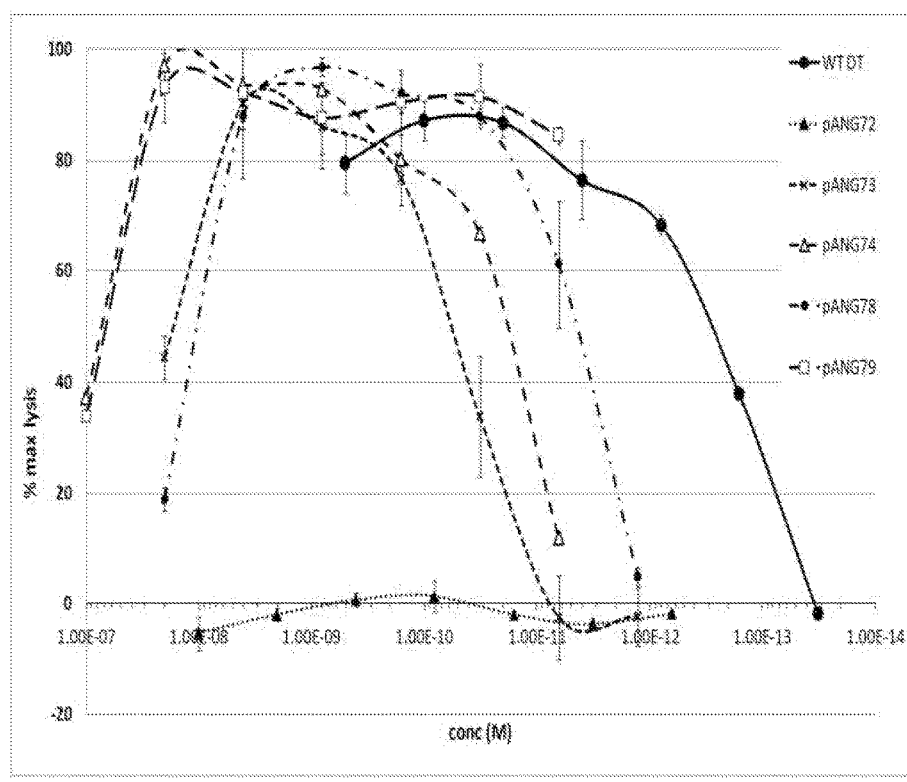
FIG. 12. Provides the % maximum lysis of a variety of DT toxins that have been modified at T cell epitopes compared to wild type DT. Constructs are as follows: pANG72—V7N I125H; pANG73—V7N 127A; pANG74—V7N R127T; pANG78—V7N V97T R127A; and pANG79—V7N V97T R127T.

FIG. 12 illustrates another example of the % maximum lysis of a variety of DT toxins that have been modified at T cell epitopes compared to wild type DT. Constructs are as follows: pANG72—V7N I125H; pANG73—V7N 127A; pANG74—V7N R127T; pANG78—V7N V97T R127A; and pANG79—V7N V97T R127T.

Figure 13:
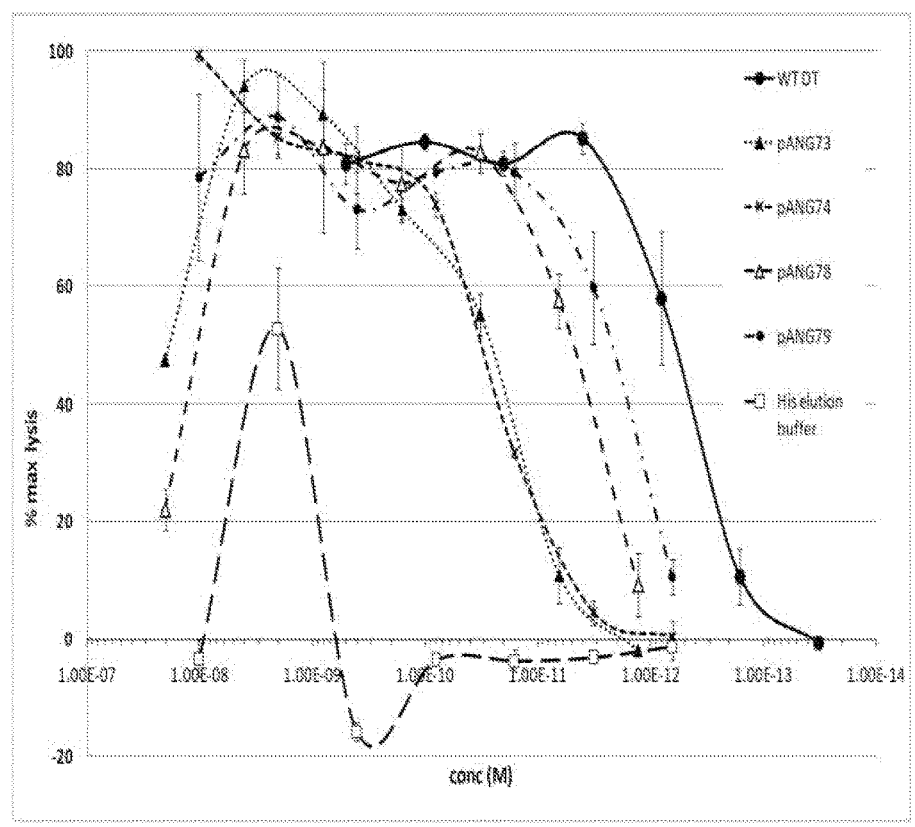
FIG. 13. Provides the % maximum lysis of a variety of DT toxins that have been modified at T cell epitopes compared to wild type DT. Constructs are as follows: pANG73—V7N 127A; pANG74—V7N R127T; pANG78—V7N V97T R127A; and pANG79—V7N V97T R127T.

FIG. 13 illustrates another example of the % maximum lysis of a variety of DT toxins that have been modified at T cell epitopes compared to wild type DT. Constructs are as follows: pANG73—V7N 127A; pANG74—V7N R127T; pANG78—V7N V97T R127A; and pANG79—V7N V97T R127T.

EC50s were determined for the constructs and the means are provided in the Table below.

| Calculated EC50 | | |
| --- | --- | --- |
| Plasmid | Variant | Average EC50 (M) |
| pANG11 | WT DT | 4.48E–13 |
| pANG72 | V7N I125H | >1.0E–8 |
| pANG73 | V7N R127A | 3.92E–11 |
| pANG74 | V7N R127T | 2.09E–11 |

-continued

| Plasmid | Variant | Average EC50 (M) |
|---|---|---|
| pANG78 | V7N V97T R127A | 5.26E-12 |
| pANG79 | V7N V97T R127T | 2.62E-12 |

NB I125A and I125T also expressed poorly and were not active (data not shown).

(c) Ribosyltransferase Assay

In addition to the coupled transcription/translation assay, a ribosyltransferase assay (such as described in Example 3) was established in a 96-well format. This assay uses samples of DT from expression of DT genes in *E. coli* and is tested in conjunction with the coupled transcription/translation assay above. Traditional methods for measuring ADP-ribosylation use permeabilized cells treated with double stranded (ds) activator DNA oligonucleotide; subsequent measurement of radiolabeled NAD+ is incorporated into acid insoluble material.

New FACS-based methods such as those described by Kunzmann et al. (2006 Immunity & Ageing) are also available.

For measurement of cytotoxicity of DT variants, a cellular cytotoxicity assay (such as described in Example 4) is developed, using HUT102-6TG cells in a 96-well format for analysis of full length DT variants (HUT102-6TG is the cell line used for final analysis of the lead DT-IL-2 protein). As the cellular cytotoxicity assay requires expression of full length DT, this assay is used after DT expression.

Example 11

Gene Synthesis, Expression and Purification

DT and human IL-2 genes are synthesized using codons optimized for expression in *E. coli* using conventional techniques known in the art. For generation of full length DT and DT(ΔR) (comprising the C and I domains only) to be used in analysis in cellular cytotoxicity and HUVEC binding assays, vector systems are used which include secretory leader sequences for export of DT into the periplasmic space of *E. coli*. The plasmid and *E. coli* strain are optimized to produce soluble product. His tagged DT products are purified on Ni-IDA columns and spin columns allow parallel purification of leads. Methods for purification of DT include, for example, purification via affinity tags fused to DT (e.g., a His6 tag (SEQ ID NO: 408)). The methods developed herein provides for reliable production of multiple DT variants with similar quality such that the activities of these variants can be accurately compared in order to identify lead candidates.

Example 12

Design and Construction of VLS Variants of DT

Variants of DT for reduction in potential to induce VLS are generated by two rounds of mutation: first, with separate mutations at each of the three (x)D(y) motifs in DT and, second, with combinations of lead mutations with optional additional mutations. Each DT variant is tested in the HUVEC binding assay and the optimal mutations selected after the second round of mutation are combined with T cell epitope mutations. Generation of DT variants for these assays is by expression of truncated DT (ΔR) in *E. coli*.

Example 13

Design, Construction, and Testing of T Cell Epitope Variants of DT

Variants of DT for elimination of T cell epitopes to reduce immunogenicity are generated by two rounds of substitutions in the C and I domains. The first round of variants involves separate substitutions at single epitope loci which are then combined in a second round of variants to generate combinations of two, three or more variant loci (depending on the number and priority of T cell epitopes). The second round of variants includes combinations with VLS variants. Due to the extra step of combining VLS mutations with T cell epitope substitutions, an optional third round of DT variants is included if further optimization of the lead DT variant is needed.

Substitutions at T cell epitope loci in DT are generated (primarily) by substituting amino acids within the core MHC binding 9-mer from the T cell epitope with amino acids which occur at homologous loci in other proteins, especially proteins related to DT, and using sequence segments from other proteins with similar tertiary structures. Analysis by the in silico peptide-MHC class II binding prediction software iTope™ (Antitope, Ltd.) is used as a guide to selected substitutions for elimination of T cell epitopes. Structural analysis of the DT crystal structure is also used as a guide to mutations least likely to reduce the activity of DT or to reduce stability of the DT structure. In certain cases, such structural analysis may suggest compensatory substitutions outside the T cell epitope loci which can accommodate certain substitutions within T cell epitopes without loss of activity or stability.

T cell epitope variants of DT are tested primarily using the rabbit reticulocyte assay for analysis of substitutions in the C domain and the cellular cytotoxicity assay for analysis of substitutions in C and I domains. Expression of DT variants for these assays uses transcription/translation and expression of full length DT in *E. coli*, respectively. For leads from the second (and optional third) round of substitutions, the ribosyltransferase and HUVEC binding assays are also used to identify lead candidates.

Twenty-six (26) epitope variants have been designed and constructed (data not shown). Ten out of twenty-six (10/26) variants have been tested in an IVTT assay as described herein. T cell epitopes have been prioritized based on relative strength (data not shown). Representative results for mutants of the seven epitopes were obtained, demonstrating that mutants have been obtained for each epitope that retain wild type activity (data not shown).

DT Epitope Variants Inhibit Protein Synthesis

A DT382 construct was used and contained amino acid residues 1-382 of SEQ ID NO: 2 or 149 of DT as well as IL2. A restriction enzyme site was engineered at amino acid residue 382 for cloning in either the R domain or the IL2 portion. Modifications are incorporated as described below.

Variants of DT382 gene were produced in which T-cell epitopes 1, 3 and 5 were modified at the putative MHC class II binding p1 anchor residues. Residues V7, L107 and F124 in the wild type DT sequence were substituted for amino acids that were predicted to remove T cell epitopes (by disrupting MHC class II binding) whilst retaining activity (individual substitutions were identified as active in the single epitope variants). The activity of single and combined variants was measured in an in vitro transcription/translation assay. Purified PCR product of each variant was titrated into a TnT coupled transcripton/translation reaction mix (#L4610 Promega, Madison Wis., according to the manufacturer's instructions) containing rabbit reticulocyte lysate, TnT buffer, T7 RNA polymerase, amino acid mix—Met, amino acid mix—Leu and RNasin (#N2511 Promega, Madison Wis.) using a DNA range from 1 ng to 64 ng per reaction in a total volume of 10.5 µl. Reactions were incubated at 30° C. for 30 minutes to allow for possible differences in the rate of DT gene translation between the different variants. Two hundred fifty (250) ng of T7-luciferase control plasmid was then added and reactions were incubated for a further 45 minutes at 30° C. Expression of luciferase was measured by luminescence after incubating the reaction with SteadyGlo luciferase assay reagent, according to manufacturer's instructions (#E2510 Promega, Madison Wis.). Luminescent readout was measured using BMG FLUOstar OPTIMA fluorescent plate reader (BMG Labtech, Durham, N.C.).

Twenty-eight (28) VLS mutants have been designed and constructed. Eighteen out of twenty-eight (18/28) VLS mutants have been tested in an IVTT assay. Known VLS variants were shown to have activity equivalent to or greater than wild type (WT) and a number of alternative VLS variants have been identified that also demonstrate activity equivalent to or greater than WT (data not shown).

Percentage inhibition of protein synthesis was plotted against DNA concentration in the reaction and the resulting curves were used to calculate the IC50 for each variant. IC50s were normalized to allow for inter-assay variation by dividing the IC50 of wild type DT (included on every assay plate) with the IC50 of the DT variant so that a value of =1 shows an equal activity to wild type, a value of >1 shows an increase in DT activity and a value of <1 shows a decrease in DT activity.

TABLE 6

IC50 data for modified DT variants compared to wild-type and a null DT variant. Data for single variants for quadruple variants was obtained (data not shown).

| Molecule | IC50 (ng/12.5 µl) | Relative Activity |
| --- | --- | --- |
| WT | 20.27 | 1.00 |
| D30N | 37.93 | 0.53 |
| S31G | 40.57 | 0.5 |
| V148A | 18.48 | 1.10 |
| Null | 46.65 | 0.43 |

Quadruple variants V7D V97A L107N F124H, V7D V97T L107N F124H, V7N V97A L107N F124H, and V7N V97T L107N F124H exhibited equivalent IC50 activity relative to WT.

Quadruple variants V7D V97D L107N F124H, V7N V97D L107N F124H, V7T V97A L107N F124H, V7T V97D L107N F124H, and V7T V97T L107N F124H exhibited improved IC50 activity relative to WT.

TABLE 7

Relative IVTT scores for VLS and/or T cell epitope variants compared to WT. The relative IVTT score is determined by dividing the $IC_{50}$ of wild type DT by the IC50 of the mutant DT.

| Mutation | Relative IVTT score | Activity Compared to WT |
| --- | --- | --- |
| V7S | 1.00 | Equivalent |
| V7T | 0.93 | Equivalent |
| V7N | 0.63 | Reduced |
| V7D | 0.57 | Reduced |
| D8E | 0.90 | Equivalent |
| D8N | 0.36 | Inactive |
| S9A | 2.25 | Improved |
| S9G | 0.48 | Inactive |

TABLE 7-continued

Relative IVTT scores for VLS and/or T cell epitope variants compared to WT. The relative IVTT score is determined by dividing the $IC_{50}$ of wild type DT by the IC50 of the mutant DT.

| Mutation | Relative IVTT score | Activity Compared to WT |
| --- | --- | --- |
| S9T | 1.50 | Equivalent |
| V29S | 3.61 | Improved |
| V29T | 1.57 | Equivalent |
| V29N | 2.47 | Improved |
| V29D | 1.51 | Equivalent |
| D30E | 2.18 | Improved |
| D30N | 0.56 | Reduced |
| S31T | 0.14 | Inactive |
| S31G | 0.26 | Inactive |
| S31N | 1.85 | Equivalent |
| I290S | 0.07 | Inactive |
| G53E | 0.43 | Inactive |
| I290S | 0.07 | Inactive |
| I290T | 4.41 | Improved |
| I290D | 0.43 | Inactive |
| D291E | 1.84 | Equivalent |
| S292A | 1.00 | Equivalent |
| S292T | 2.11 | Improved |
| S292G | 0.65 | Reduced |
| V97A | 3.50 | Improved |
| V97T | 2.57 | Improved |
| V97D | 4.15 | Improved |
| L107A | 0.61 | Reduced |
| L107N | 1.45 | Equivalent |
| M116A | 1.29 | Equivalent |
| M116Q | 0.90 | Equivalent |
| M116N | 1.25 | Equivalent |
| F124A | 0.42 | Inactive |
| F124H | 1.51 | Equivalent |
| F124K | 0.47 | Inactive |
| V148A | 0.83 | Equivalent |
| V148T | 1.48 | Equivalent |
| L298A | 0.80 | Equivalent |
| L298N | 1.65 | Equivalent |
| V7N V29N | 1.18 | Equivalent |
| V7N V29T | 1.56 | Equivalent |
| V7N V29D | 1.18 | Equivalent |
| V7T V29N | 0.78 | Equivalent |
| V7T V29T | 0.97 | Equivalent |
| V7T V29D | 1.15 | Equivalent |
| V7D L107A F124H | 1.14 | Equivalent |
| V7D L107N F124H | 2.07 | Improved |
| V7N L107A F124H | 1.46 | Equivalent |
| V7N L107N F124H | 1.87 | Equivalent |
| V7T L107A F124H | 1.19 | Equivalent |
| V7T L107N F124H | 1.55 | Equivalent |

The relative activities of epitope variants of DT382 compared to wild type DT382 in the inhibition of protein synthesis were determined (data not shown). The data shows that the following T cell epitope variants of DT; V7N L107N F124H, V7N L107A F124H, V7D L107N F124H, V7D L107A F124H, V7T L107N F124H and V7T L107A F124H, and V7T V29T I290T all show similar activity to wild type DT382 in the inhibition of protein synthesis. In contrast, a G53E substitution results in a decrease in activity. As described herein, a reference to a G52 modification refers to amino acid residue numbering of a DT molecule of SEQ ID NO: 1 that does not contain the N-terminal methionine.

Example 14

DT VLS Variants Inhibit Protein Synthesis

Variants of DT382 gene were produced where VLS motifs were mutated such that the recognized x(D)y motif was disrupted. The activity of variants at single and multiple loci were assessed for activity in an in vitro transcription/translation assay using PCR products (as described for example 1).

The relative activities of VLS variants of DT382 compared to wild type DT382 in the inhibition of protein synthesis were determined (data not shown). The data shows that the following VLS variants; V7N V29N I290N, V7N V29N I290T, V7N V29N S292A, V7N V29N S292T, V7N V29T I290N, V7N V29T I290T, V7N V29T S292A and V7N V29T S292T all show equivalent activity to DT382 in the inhibition of protein synthesis.

Example 15

Binding of VLS Variants to HUVECs

Human vascular endothelial cells (HUVEC) were maintained in EBM (CC-3124 Lonza, Basel, Switzerland). Before use, cells were detached from plastic substratum using an enzyme free dissociation buffer (C5914 Sigma, Poole, UK) and re-suspended in phosphate buffered saline containing 1% BSA and 0.05% $NaN_3$. Cells were then incubated in the same buffer containing 5% normal human serum for 20 minutes before adding a titration of purified DT382 protein or DT382 VLS variants that had been conjugated to Alexa488 fluorochrome (A30006 Invitrogen, Carlsbad Calif.), according to the manufacturer's instructions. The cells were incubated with the labelled protein for 30 minutes before being washed and re-suspended in PBS+ 1% BSA+0.05% $NaN_3$ buffer. Labelled DT-389-IL2 fusion was used as a positive control and labelled BSA was used as a negative control. Cells were then analyzed on a FACSCalibur flow cytometer (Becton Dickinson, Franklin Lakes, N.J.) and fluorescent staining of the cell population was measured. The percentage of cells that showed above background staining was then plotted against the concentration of labelled protein used.

Binding of labelled DT382 VLS variants to HUVEC cells was determined (data not shown). Labelled DT-389-IL2 fusion (ONTAK®) was used as a positive control and labelled BSA was used as a negative control. The data shows that purified Alexa488 labelled DT382 and DT389-IL2 (positive control) bind to HUVEC at similar levels. In contrast, binding of the VLS variants V7N V29T S292A, V7N V29T I290N, and V7N V29N I290N exhibit a reduced level of binding to HUVECs compared to either DT382 or DT389-IL2.

FIG. 16 demonstrates direct binding of directly labelled DTΔR, VLS mutants and controls to HUVEC cells.

Example 16

The sequences of DT derived peptides were analyzed using Antitope's iTope™ software which predicted potential MHC class II binding peptides. The iTope™ software combines data from in vitro MHC class II binding studies with alignments of large databases of peptides that have been demonstrated to be T cell epitopes via ex vivo T cell assays into scoring matrices. Overlapping 13mer peptides were screened using iTope™ in 1 amino acid increments for the entire DT sequence. Binding scores were generated by summing the contribution of each amino acid within a peptide at key pocket positions as derived from the scoring matrices. Peptides (9mers) containing potential T cell epitopes were identified (underlined sequence) where the mean binding scores where >0.6 (for the 32 MHC class II alleles tested) and where >15 MHC class II alleles were predicted to bind (data not shown). The p1 anchor position of each 9mer is highlighted in bold and the full list of potential binding peptides is summarized in Table 8. For comparison T cell epitopes identified using ex vivo T cell assays are shown in boxes.

TABLE 8

List of 9mer sequences predicted to contain T cell epitopes using iTope™ MHC class II binding software.

| 9mer peptide | SEQ ID NO |
|---|---|
| MGADDVVDS | 203 |
| VVDSSKSFV | 204 |
| VDSSKSFVM | 205 |
| MENFSSYHG | 206 |
| VDSIQKGIQ | 207 |
| LTKVLALKV | 208 |
| VDNAETIKK | 209 |
| LGLSLTEPL | 210 |
| MEQVGTEEF | 211 |
| VEYINNWEQ | 212 |
| WEQAKALSV | 213 |
| MYEYMAQAC | 214 |
| IRDKTKTKI | 215 |
| LKEHGPIKN | 216 |
| LSELKTVTG | 217 |
| VNVAQVIDS | 218 |
| VIDSETADN | 219 |
| LEKTTAALS | 220 |
| LSILPGIGS | 221 |
| LPGIGSVMG | 222 |
| IVAQSIALS | 223 |
| VAQSIALSS | 224 |
| IALSSLMVA | 225 |
| LSSLMVAQA | 226 |
| LMVAQAIPL | 227 |
| MVAQAIPLV | 228 |
| VAQAIPLVG | 229 |
| VESIINLFQ | 230 |
| IINLFQVVH | 231 |
| INLFQVVHN | 232 |
| VHNSYNRPA | 233 |

Example 17

Construction and Expression of Variant DT-IL2

Lead DT-IL2 variants are generated by fusion of a lead DT variants with the human-IL2 (2-133) gene. Expression of the wild-type and lead DT-IL2 variant in *E. coli* follows conventional methods for, for example, DT-IL2 involving accumulation of protein aggregates in inclusion bodies and refolding. Wild-type and one or more lead DT-IL2 variants are then tested in the cytotoxicity and VLS-related assays.

Example 18

Immunogenicity Testing of Lead DT Variants Using

Lead DT (ΔR) variants are purified and compared against the wild-type DT (ΔR) using EPISCREEN® time course T cell assays. A large number of healthy donors representing the world population according to expression of HLA allotypes are selected from a donor library as described above. Donors are stimulated with each protein in separate bulk cultures containing 2-4×$10^6$ $CD8^+$ T cell depleted PBMC. Replicate samples (of T blasts) are removed from bulk cultures on days 5-8, and proliferation along with IL-2 secretion (ELISPOT) is assessed. To further validate the assessment between wild type and DT (ΔR) variants, the study cohort is supplemented with responding donors from the EpiScreen™ T cell epitope mapping study (provided sufficient numbers of $CD8^+$ T cell depleted PBMC remain).

In order to confirm loss of immunogenicity in lead DT (ΔR) variants, an analysis of T cell immunogenicity by EPISCREEN® time course T cell assays is undertaken as follows:

(i) Buffy coats from healthy donors (with >80% DRB1 allotypic coverage for world population) are used to isolate PBMC which contain physiological levels of APC and CD4+ T cells;

(ii) Each donor is tested against positive control antigens including keyhole limpet haemocyanin (a potent neoantigen) or Tetanus Toxoid (recall antigen);

(iii) CD8+ T cells are depleted to exclude the detection of MHC class I restricted T cell responses;

(iv) Lead DT (ΔR) variants and wild-type DT (ΔR) are compared against each other to evaluate relative capacity to activate T cells CD4+ T cells;

(v) Data is analyzed using previously validated assay parameters with positive responses of SI≥2 supported by additional information including statistical and frequency analysis;

(vi) Data from EPISCREEN® time course T cell assays provides information on the magnitude and kinetics of T cell responses to individual DT molecules;

(vii) Any remaining PBMC from donors that produce positive responses is archived and is available for use in repeat testing studies; and (viii) An assessment is made of association between donor allotype and responses to DT (ΔR) and any responses to variant DT (ΔR) leads.

Immunogenicity data from these experiments is as follows:

| Test Condition | Mean SI | Standard Deviation | Frequency of Response (%) |
|---|---|---|---|
| | Proliferation | | |
| DiDTDR | 6.01* | 4.96 | 8 |
| DTDR | 3.76 | 2.87 | 58 |
| A33 | 3.57 | 1.78 | 32 |
| KLH | 9.97 | 10.35 | 90 |
| | IL-2 ELISPOT | | |
| DiDTDR | 3.10 | 1.48 | 10 |
| DTDR | 2.72 | 1.82 | 52 |
| KLH | 5.65 | 4.73 | 90 |

*High SI is due to a single responder; NB high SD.

Example 19

Adjuvant Effect of DT Variant-IL2 Fusion Proteins

Clinical Trial Design and Patient Eligibility

Treatment of patients is performed following written informed consent as part of a protocol approved by an Institutional Review Board and the FDA. Patients with histologically confirmed metastatic RCC are eligible for study. All patients are required to have adequate hepatic, renal, and neurological function, a life expectancy of more than 6 months, and a Karnofsky performance status of greater than or equal to 70%. Patients are to have recovered from all toxicities related to any prior therapy and not received any chemotherapy, radiation therapy, or immunotherapy for at least 6 weeks prior to study entry. Excluded from this study are patients with CNS metastases, with a history of autoimmune disease, and with serious intercurrent chronic or acute illnesses. Patients on immunosuppressive agents are also excluded. Eligible subjects are randomized with equal probability to receive either a single dose of DT variant-IL2 fusion protein (18 μg/kg) followed by immunization with tumor RNA-transfected DCs or DT variant-IL2 fusion protein alone. All subjects receive 3 intradermal injections of tumor RNA-transfected DCs. The injections are administered intradermally at biweekly intervals and consist of 1×$10^7$ cells suspended in 200 μl 0.9% sodium chloride at each injection. Following treatment, subjects are evaluated for clinical toxicity and immunological and clinical responses. Due to regulatory restrictions and, in some subjects, limited access to rumor tissue, no tumor biopsies are performed.

DT Variant-IL2 Fusion Protein and Composition Preparation

DT variant-IL2 fusion protein is provided as a frozen, sterile solution formulated in citrate buffer in 2 ml single-use vials at a concentration of 150 μg/ml. After thawing, DT variant-IL2 fusion protein is diluted with sterile normal saline to a final concentration of 15 μg/ml and delivered by intravenous infusion over a 30-minute period. Patients are permitted to receive acetaminophen (600 mg) and antihistamines 30 to 60 minutes prior to infusion. For DC culture, a concentrated leukocyte fraction is harvested by leukapheresis. PBMCs are isolated from the leukapheresis product by density gradient centrifugation (Histopaque; Sigma-Aldrich). The semiadherent cell fraction is used for DC culture in serum-free X-VIVO 15 medium (Cambrex Corp.) supplemented with recombinant human IL-4 (500 U/ml;

R&D Systems) and recombinant human GM-CSF (rhGM-CSF; 800 U/ml; Immunex Corp.). After 7 days, immature DCs are harvested and transfected with total RNA extracted from tumor tissues histologically classified as clear cell carcinoma. Control RNA used for immunological monitoring studies is isolated from autologous benign renal tissues (RE) or from PBMCs. Transfection of immature DCs is carried out by electroporation. DCs are washed in PBS and resuspended at a concentration of $4\times10^7$ cells/ml in ViaSpan (Barr Laboratories). Cells are then co-incubated for 5 minutes with 5 μg RNA per $1\times10^6$ cells and electroporated in 0.4 cm cuvettes via exponential decay delivery at 300 V and 150 μF (Gene Pulser II; Bio-Rad). After electroporation, cells are re-suspended in X-VIVO 15 medium and matured for 20 hours in the presence of 10 ng/ml TNF-α, 10 ng/ml IL-1β, 150 ng/ml IL-6 (R&D Systems), and 1 μg/ml prostaglandin $E_2$ ($PGE_2$; Cayman Chemical Co.). Prior to administration, cells are characterized to ensure that they met the typical phenotype of fully mature DCs: $Lin^{neg}$, HLA class I and $II^{high}$, $CD86^{high}$, and $CD83^{high}$.

Evaluation of Immune Status.

IFN-γ and IL-4 ELISPOT analyses are performed using PBMCs obtained prior to, during, and after immunization. PBMCs are cultured overnight in complete RPMI 1640 medium. CD4+ and CD8+ T cells are isolated from PBMCs by negative depletion (Miltenyi Biotec). After blocking, $1\times10^5$ T cells and $1\times10^4$ RNA-transfected DCs are added to each well of 96-well nitrocellulose plates (Multiscreen-IP; Millipore) precoated with 2 μg/ml IFN-γ capture antibody (Pierce Biotechonology Inc.) or with IL-4 capture antibody (BD Biosciences Pharmingen). Plates are incubated for 20 hours at 37° C., and biotinylated IFN-γ detection antibody (Pierce Biotechonology Inc.) or biotinylated IL-4 antibody (BD Biosciences Pharmingen) is added to each well. Cells are then incubated for an additional 2 hours at room temperature, then with streptavidin-alkaline phosphatase (1 μg/ml; Sigma-Aldrich) is added; plates are developed with substrate (KPL). After washing, spots are counted using an automated ELISPOT reader (Zeiss).

CTL assays are performed by co-culturing RNA-transfected DCs with autologous PBMCs. Cells are re-stimulated once, and IL-2 (20 units/ml) is added after 5 days and every other day thereafter. After 12 days of culture, effector cells are harvested. Target cells are labeled with 100 μCi of $Na_2[51CrO_4]$ (PerkinElmer) in 200 μl of complete RPMI 1640 for 1 hour at 37° C. in 5% $CO_2$, and $^{51}Cr$-labeled target cells are incubated in complete RPMI 1640 medium with effector cells for 5 hours at 37° C. Then 50 μl of supernatant is harvested, and release of 51Cr is measured with a. scintillation counter.

For proliferation assays, purified CD3+ T cells are seeded into round-bottomed microplates in the presence of mRNA-transfected DCs. T cells alone are used as the background control. After 4 days, 1 μCi of [methyl-$^3$H] thymidine (PerkinElmer) is added to each well for an additional 16 hours. Incorporation of thymidine is determined using a liquid scintillation counter.

Cytotoxicity of DT variant-IL2 fusion protein is determined in MTT assays. After 6 hours incubation with varying concentrations of DT variant-IL2 fusion protein, cells are seeded in 96-well plates at a density of $5\times10^3$ cells/well. After 48 hours of incubation, 20 μl MTT from a 5 mg/ml stock is added. After 4 hours, the formazan crystals are solubilized by adding 100 μl isopropanol/0.1 M hydrochloric acid. The absorbance of the formazan product is measured on an ELISA plate reader at 570 nm.

Cytokine secretion by vaccine-induced CD4+ T cells is measured using the human Th-1/Th-2 cytokine kit (Cytokine Bead Array; BD Biosciences Pharmingen) according to the manufacturer's instructions. Isolated CD4+ T cells are re-stimulated overnight with RNA-transfected DCs at a ratio of 10:1.

Four-color FACS analyses are performed using the following antibodies: anti-CD4 FITC, anti-CD45RO, anti-CD45RA (CALTAG Laboratories), anti-CD25 PE (BD Biosciences Pharmingen), and anti-GITR(R&D Systems) as well as isotypic controls (CALTAG Laboratories). Sorting of CD4+/CD25neg, CD4+/CD25int and CD4+/CD25high T cells is performed using a BD FACSAria cell sorter after antibody labeling. For intracellular detection of FoxP3, cells are permeabilized with 30 μg/ml digitonin for 45 minutes at 4° C. Subsequently, cells are stained with anti-FoxP3 antibody (Abcam), and R-phycoerythrin anti-goat IgG in the presence of 10 m/ml digitonin for 30 minutes 4° C. Following staining, cells are fixed analyzed by FACS. For intracellular CTLA-4 detection, T cells are permeabilized, fixed, and stained with biotinylated anti-CD152 (BD Biosciences Pharmingen) followed by APC-strepavidin (BD Biosciences Pharmingen). A total of $1\times10^6$ cells are suspended in staining buffer (PBS with 1% PCS, 2 mM EDTA, and 0.1% sodium aside) and incubated for 20 minutes at 4° C. with the antibody.

The suppressive activity of Tregs isolated from PBMCs of study subjects prior to and 4 days after DT variant-IL2fusion protein administration is analyzed as described previously (Tsaknaridis et al. 2003. J. Neurosci. Res. 74: 296-308). CD4+/CD25+ T cells are isolated from the PBMCs of study subjects using magnetic bead separation techniques. Cells are washed with PBS, re-suspended in complete RPMI 1640 medium, and placed into 96-well round bottom plates precoated with anti-CD3/CD28 antibodies (0.4 μg/well) (CALTAG Laboratories). CD4+/CD25-cells are plated at $2.0\times10^4$/well alone or in combination with CD4+/CD25+ cells in triplicate wells at a ratio of 1:2 (CD4+/CD25:CD4+ CD25+). On day 5, 1 μCi of $^3$H-thymidine is added for the final 16 hours of the cultures. Cells are then harvested on glass fiber filters and assessed for uptake of radiolabeled thymidine.

Details of real-time PCR-based quantification of β-actin transcripts are previously described in the literature. FoxP3 mRNA transcripts are quantified using the Hs00203958 ml Taq-Man gene expression assay (Applied Biosystems) according to the protocol provided by the manufacturer. A plasmid containing the full-length FoxP3 insert is used to generate standard curves.

T cell analysis before and after treatment is performed by IFN-γ ELISPOT on all patients who completed immunotherapy. Increases of antigen-specific CD4+ and CD8+ T cells after immunization are compared using the Wilcoxon matched-pairs signed rank test, analyzing the null hypothesis that the rates of change in T cell response are equivalent prior to and after therapy. A 2-sided P value of less than 0.05 is considered statistically significant.

Example 20

Cytotoxicity Study of Variants of DT in Vero Cells

The following variants of DT proteins were constructed, expressed, and purified according to EXAMPLE 1. Cytotoxicity assays were conducted according to the protocol described herein and the results were compared to the cytotoxicity levels of the wild type DT.

| Variant | Anchor position | Average ED50 (M) | Fold difference from WT |
|---|---|---|---|
| WT | — | 6.0E−13 | 1.00 |
| F13Y | p7 | 6.2E−13 | 1.03 |
| F13D | p7 | 7.1E−12 * | 9.81 * |
| M15D | p9 | 4.0E−12 | 6.67 |
| M15T | p9 | 3.9E−12 | 6.50 |
| S12G | p6 | 8.6E−12 | 14.33 |

Results: DT variants exhibited significant cytotoxicity comparable to DT wt.

Example 21

Cytotoxicity Study of Variants of DT-IL2 Fusion Protein

The following variants of DT-IL2 fusion proteins were constructed, expressed, and purified according to EXAMPLE 1.

| Variant name | Epitope 1 | Epitope 2 | Epitope 3 | Epitope 4 | Epitope 5 | Epitope 6 | Epitope 7 | IL-2 |
|---|---|---|---|---|---|---|---|---|
| DT F130, S306G-IL2 | F13D | V97T | T112D | E117D | R127A | V148T | S306G | C1255 |
| DT M150, S306G-IL2 | M15D | V97T | T112D | E117D | R127A | V148T | S306G | C1255 |
| DT M15T, S306G-IL2 | M15T | V97T | T112D | E117D | R127A | V148T | S306G | C1255 |
| DT wt-IL2 | wt | wt | wt | wt | wt | wt | wt | C1255 |

Cytotoxicity assays were conducted according to the protocol described herein. HH-CD25 cells were treated with 2-fold serial dilutions of diphtheria toxin variants for a total of six concentrations (in duplicate), with analysis of live/dead cells by flow cytometry at day 4.5 (Forward scatter vs. 7AAD). Final protein concentrations were 1000, 500, 250, 125, 62.5, and 31.3 ng/ml.

Two-fold serial dilutions of Ontak/DT-IL2 proteins are prepared in 48-well tissue culture plates. The culture medium is RPMI-1640 supplemented with 10% FBS and the antibiotic is Pen/Strep.

In a 48-well plate, set up DT-IL2 dilutions as follows: In the first well of each dilution set, plate 2,000 ng/ml of DT-IL2 in a total of 1 ml medium. For example, if the DT-IL2 concentration is 500 ng/μl, then plate 996 μl of medium+4.0 μl of DT-IL2. Be sure to use an accurate P-1000 pipette for the medium and an accurate P-10 pipette or equivalent to pipette the DT-IL2. Mix well.

In all other wells of each dilution set, pipette 500 μl of medium. Then, using a P-1000 pipette, perform routine serial dilutions by transferring 500 μl from well 1 to well 2 (mix thoroughly), then from well 2 to well 3, and so on for a total of 8-10 dilutions. Discard the final 500 μl of unused material after the final dilution.

When the dilutions are complete, transfer into each well 500 μl of HH-CD25 cells in RPMI medium at a starting concentration of $4 \times 10^4$ cells/ml.

So when complete, all wells have 1.0 ml total volume. The concentration of DT-IL2 in well #1 is 1000 ng/ml (16.6 nM), in well #2 is 500 ng/ml, in well #3 is 250 ng/ml, and so on. There are 20,000 HH-CD25 cells/well for all wells. Culture 4-6 wells of untreated cells as controls for a no treatment group. Also, do the dilutions in triplicate if statistical analysis is desired.

Culture the plates at 37° C. and 5% $CO_2$ for 5 days. On day 5, re-suspend the cells in each well thoroughly using a P-1000 pipette and transfer to individual FACS tubes for flow cytometry analysis. Centrifuge the cells, wash 1× in DPBS, and then re-suspend the cells in 250 μl of DPBS containing a 1:500 dilution of 7-AAD live/dead stain (BD Pharmingen). Keep the cells on ice in a staining tray from this point forward.

Analyze the cells by flow cytometry for 2 parameters, forward scatter (FSC) vs. 7-AAD incorporation. For subsequent analysis using Flowjo software (or equivalent), first make a gate that excludes cell debris (low forward scatter material that includes membrane fragments, organelles, apoptotic bodies, etc.). Then, make a second gate to determine the frequency of live cells (7-AAD negative, large by FSC) relative to dead cells (7-AAD positive, small by FSC) in each sample.

Results are normally plotted as the following ratio: % live cells in each treatment group/% live cells in the untreated control group.

Results: DT M15T, S306G-IL2 exhibited significant cytotoxicity comparable to DT wt-IL2 (FIG. 19: DT-IL2 concentration, from left to right: 1. 1000 ng/ml (16.6 nM); 2. 500 ng/ml (8.32 nM); 3. 250 ng/ml (4.16 nM); 4. 125 ng/ml (2.08 nM); 5. 62.5 ng/ml (1.04 nM); 6. 31.3 ng/ml (0.52 nM)). DT M15T, S306G-IL2 exhibited unexpectedly superior cytotoxicity compared to DT M15D, S306G-IL2 and DT F13D, S306G-IL2.

Example 22

Cytotoxicity Study of Variants of DT-Herceptin ScFv Fusion Protein

The following variants of DT-herceptin ScFv fusion proteins were constructed, expressed, and purified according to EXAMPLE 1.

1) DTwt-HER (1000 ug/ml stock); 2) DT-M15T, S306G-HER (900 ug/ml stock); 3) Herceptin (ET101H mAb from Eureka Therapeutics, Inc.; 3000 ug/ml stock).

Cytotoxicity assays were conducted according to the protocol described herein. MDA-MB-468 cells (HER2 negative) and SK-BR-3 cells (HER2 positive) were used as negative control and for testing cytotoxicity of variants, respectively. Cells were treated with 2-fold serial dilutions of DT-HER ScFv variants for a total of 18 concentrations. On day 5 the cells were harvested, with trypsin used to detach live, adherent cells. Analysis of live/dead cells was performed by flow cytometry (Forward scatter vs. 7AAD). Protein concentrations ranged from 2.5 μg/ml to 19 pg/ml.

Results: None of the proteins tested exhibited cytotoxicity in MDA-MB-468 cells (HER2 negative) as expected (FIG. 20). DT M15T, S306G-HER exhibited significant cytotoxicity comparable to DT wt-HER (FIG. 21). DT-herceptin ScFv concentration, from left to right: 1. 2500 ng/ml (34.6 nM); 2. 1250 ng/ml (17.3 nM); 3. 625 ng/ml (8.65 nM); 4. 313 ng/ml (4.33 nM); 5. 156 ng/ml (2.16 nM); 6. 78.1 ng/ml (1.08 nM); 7. 39.1 ng/ml (541 pM); 8. 19.5 ng/ml (270 pM); 9. 9.8 ng/ml (136 pM); 10. 4.9 ng/ml (67.8 pM); 11. 2.4 ng/ml (33.2 pM); 12. 1.2 ng/ml (16.6 pM); 13. 0.61 ng/ml (8.44 pM); 14. 0.31 ng/ml (4.29 pM); 15. 0.15 ng/ml (2.08 pM); 16. 0.076 ng/ml (1.05 pM); 17. 0.038 ng/ml (526 fM); 18. 0.019 ng/ml (263 fM).

Example 23

Cytotoxicity Study of Variants of DT-Herceptin ScFv Fusion Protein in Two HER2 Positive Cell Lines The following variants of DT-herceptin ScFv fusion proteins were constructed, expressed, and purified according to EXAMPLE 1.
1) DiDT-HER (DT-M15T, S306G-HER; 900 ug/ml stock); 3) Herceptin biosimilar (ET101H mAb from Eureka Therapeutics, Inc.; 3000 ug/ml stock).
Cytotoxicity assays were conducted according to the protocol described herein. BT-474 cells (HER2 positive) and SK-BR-3 cells (HER2 positive) were used for testing cytotoxicity of variants. Cells were treated with 2-fold serial dilutions of DiDT-HER ScFv for a total of 24 concentrations ranging from 2500 ng/ml to 0.3 μg/ml. ET101H was used at only the highest 12 concentrations. On day 5 the cells were harvested, with trypsin used to detach live, adherent cells. Analysis of live/dead cells was performed by flow cytometry (Forward scatter vs. 7AAD).

Results: DT M15T, S306G-HER exhibited significant cytotoxicity comparable to DT wt-HER (FIG. 22). DT-herceptin ScFv concentration, from left to right: 1. 2500 ng/ml (34.6 nM); 2. 1250 ng/ml (17.3 nM); 3. 625 ng/ml (8.65 nM); 4. 313 ng/ml (4.33 nM); 5. 156 ng/ml (2.16 nM); 6. 78.1 ng/ml (1.08 nM); 7. 39.1 ng/ml (541 pM); 8. 19.5 ng/ml (270 pM); 9. 9.8 ng/ml (135 pM); 10. 4.9 ng/ml (67.6 pM); 11. 2.4 ng/ml (33.8 pM); 12. 1.2 ng/ml (16.9 pM); 13. 0.61 ng/ml (8.45 pM); 14. 0.31 ng/ml (4.22 pM); 15. 0.15 ng/ml (2.11 pM); 16. 0.076 ng/ml (1.06 pM); 17. 0.038 ng/ml (528 fM); 18. 0.019 ng/ml (264 fM); 19. 0.0095 ng/ml (132 fM); 20. 0.0048 ng/ml (66 fM); 21. 0.0024 ng/ml (33 fM); 22. 0.0012 ng/ml (16 fM); 23. 0.0006 ng/ml (8.2 fM); 24. 0.0003 ng/ml (4.1 fM). ET was used at the highest twelve concentrations shown at left (from 2500 ng/ml to 1.2 ng/ml).

Example 24

Exemplary modified diphtheria toxin molecules made using the methods described herein include, but are not limited to, those provided below. Diphtheria toxin molecules have been modified in one or more VLS motifs, one or more T cell epitopes or a combination thereof.
Diphtheria Toxin-ΔR Amino Acid Sequences

```
DT382-FLAG-His (SEQ ID NO: 412):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYSEL

ADYKDDDDKGLEHHHHHH.

DT382 (V7S) (SEQ ID NO: 413):
MGADDVSDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T) (SEQ ID NO: 414):
MGADDVTDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N) (SEQ ID NO: 415):
MGADDVNDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV
```

-continued

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7D) (SEQ ID NO: 416):
MGADDVDDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (D8E) (SEQ ID NO: 417):
MGADDVVESSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (D8N) (SEQ ID NO: 418):
MGADDVVNSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S9A) (SEQ ID NO: 419):
MGADDVVDASKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S9G) (SEQ ID NO: 420):
MGADDVVDGSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S9T) (SEQ ID NO: 421):
MGADDVVDTSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG
AVHHNTEEIVAQSIALSSLMVAQAIPLVGELVDIGFAAYNFVESIINLFQVVHNSYNRPAYS.

DT382 (V29S) (SEQ ID NO: 422):
MGADDVVDSSKSFVMENFSSYHGTKPGYSDSIQKGIQKPKSGTQGNYDDDWKGFYSTDNKYDAA
GYSVDNENPLSGKAGGVVKVTYPGLTKVLALKVDNAETIKKELGLSLTEPLMEQVGTEEFIKRF
GDGASRVVLSLPFAEGSSSVEYINNWEQAKALSVELEINFETRGKRGQDAMYEYMAQACAGNRV
RRSVGSSLSCINLDWDVIRDKTKTKIESLKEHGPIKNKMSESPNKTVSEEKAKQYLEEFHQTAL
EHPELSELKTVTGTNPVFAGANYAAWAVNVAQVIDSETADNLEKTTAALSILPGIGSVMGIADG
AVHHNTEEIVAQSIALSSLMVAQAIPLVGELVDIGFAAYNFVESIINLFQVVHNSYNRPAYS.

DT382 (V29T) (SEQ ID NO: 423):
MGADDVVDSSKSFVMENFSSYHGTKPGYTDSIQKGIQKPKSGTQGNYDDDWKGFYSTDNKYDAA
GYSVDNENPLSGKAGGVVKVTYPGLTKVLALKVDNAETIKKELGLSLTEPLMEQVGTEEFIKRF
GDGASRVVLSLPFAEGSSSVEYINNWEQAKALSVELEINFETRGKRGQDAMYEYMAQACAGNRV
RRSVGSSLSCINLDWDVIRDKTKTKIESLKEHGPIKNKMSESPNKTVSEEKAKQYLEEFHQTAL
EHPELSELKTVTGTNPVFAGANYAAWAVNVAQVIDSETADNLEKTTAALSILPGIGSVMGIADG
AVHHNTEEIVAQSIALSSLMVAQAIPLVGELVDIGFAAYNFVESIINLFQVVHNSYNRPAYS.

DT382 (V29N) (SEQ ID NO: 424):
MGADDVVDSSKSFVMENFSSYHGTKPGYNDSIQKGIQKPKSGTQGNYDDDWKGFYSTDNKYDAA
GYSVDNENPLSGKAGGVVKVTYPGLTKVLALKVDNAETIKKELGLSLTEPLMEQVGTEEFIKRF
GDGASRVVLSLPFAEGSSSVEYINNWEQAKALSVELEINFETRGKRGQDAMYEYMAQACAGNRV
RRSVGSSLSCINLDWDVIRDKTKTKIESLKEHGPIKNKMSESPNKTVSEEKAKQYLEEFHQTAL
EHPELSELKTVTGTNPVFAGANYAAWAVNVAQVIDSETADNLEKTTAALSILPGIGSVMGIADG
AVHHNTEEIVAQSIALSSLMVAQAIPLVGELVDIGFAAYNFVESIINLFQVVHNSYNRPAYS.

DT382 (V29D) (SEQ ID NO: 425):
MGADDVVDSSKSFVMENFSSYHGTKPGYDDSIQKGIQKPKSGTQGNYDDDWKGFYSTDNKYDAA
GYSVDNENPLSGKAGGVVKVTYPGLTKVLALKVDNAETIKKELGLSLTEPLMEQVGTEEFIKRF
GDGASRVVLSLPFAEGSSSVEYINNWEQAKALSVELEINFETRGKRGQDAMYEYMAQACAGNRV
RRSVGSSLSCINLDWDVIRDKTKTKIESLKEHGPIKNKMSESPNKTVSEEKAKQYLEEFHQTAL
EHPELSELKTVTGTNPVFAGANYAAWAVNVAQVIDSETADNLEKTTAALSILPGIGSVMGIADG
AVHHNTEEIVAQSIALSSLMVAQAIPLVGELVDIGFAAYNFVESIINLFQVVHNSYNRPAYS.

DT382 (D30E) (SEQ ID NO: 426):
MGADDVVDSSKSFVMENFSSYHGTKPGYVESIQKGIQKPKSGTQGNYDDDWKGFYSTDNKYDAA
GYSVDNENPLSGKAGGVVKVTYPGLTKVLALKVDNAETIKKELGLSLTEPLMEQVGTEEFIKRF
GDGASRVVLSLPFAEGSSSVEYINNWEQAKALSVELEINFETRGKRGQDAMYEYMAQACAGNRV
RRSVGSSLSCINLDWDVIRDKTKTKIESLKEHGPIKNKMSESPNKTVSEEKAKQYLEEFHQTAL
EHPELSELKTVTGTNPVFAGANYAAWAVNVAQVIDSETADNLEKTTAALSILPGIGSVMGIADG
AVHHNTEEIVAQSIALSSLMVAQAIPLVGELVDIGFAAYNFVESIINLFQVVHNSYNRPAYS.

DT382 (D30N) (SEQ ID NO: 427):
MGADDVVDSSKSFVMENFSSYHGTKPGYVNSIQKGIQKPKSGTQGNYDDDWKGFYSTDNKYDAA
GYSVDNENPLSGKAGGVVKVTYPGLTKVLALKVDNAETIKKELGLSLTEPLMEQVGTEEFIKRF
GDGASRVVLSLPFAEGSSSVEYINNWEQAKALSVELEINFETRGKRGQDAMYEYMAQACAGNRV
RRSVGSSLSCINLDWDVIRDKTKTKIESLKEHGPIKNKMSESPNKTVSEEKAKQYLEEFHQTAL

```
EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S31T) (SEQ ID NO: 428):
MGADDVVDSSKSFVMENFSSYHGTKPGYVDTIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S31G) (SEQ ID NO: 429):
MGADDVVDSSKSFVMENFSSYHGTKPGYVDGIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S31N) (SEQ ID NO: 430):
MGADDVVDSSKSFVMENFSSYHGTKPGYVDNIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKM.SESPNKTVSEEKAKQYLEEFHQTA

LEHPELSELKTVTGTNPVFAGANYAAWAVNVAQVIDSETADNLEKTTAALSILPGIGSVMGIAD

GAVHHNTEEIVAQSIALSSLMVAQAIPLVGELVDIGFAAYNFVESIINLFQVVHNSYNRPAYS.

DT382(I290S) (SEQ ID NO: 431):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVSDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (I290T) (SEQ ID NO: 432):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVTDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (I290D) (SEQ ID NO: 433):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV
```

```
RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVDDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (D291E) (SEQ ID NO: 434):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIESETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S292A) (SEQ ID NO: 435):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDAETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S292T) (SEQ ID NO: 436):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDTETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S292G) (SEQ ID NO: 437):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDGETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V29N) (SEQ ID NO: 438):
MGADDVNDSSKSFVMENFSSYHGTKPGYNDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V29T) (SEQ ID NO: 439):
MGADDVNDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL
```

-continued

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V29D) (SEQ ID NO: 440):
MGADDVNDSSKSFVMENFSSYHGTKPGYDDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V29N) (SEQ ID NO: 441):
MGADDVTDSSKSFVMENFSSYHGTKPGYNDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V29T) (SEQ ID NO: 442):
MGADDVTDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V29D) (SEQ ID NO: 443):
MGADDVTDSSKSFVMENFSSYHGTKPGYDDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V29N I290N)-FLAG-His: Variant 13
(SEQ ID NO: 444):
MGADDVNDSSKSFVMENFSSYHGTKPGYNDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVNDSETADNLEKTTAALSILPGIGSVMGIADG

AVHHNTEEIVAQSIALSSLMVAQAIPLVGELVDIGFAAYNFVESIINLFQVVHNSYNRPAYSEL

ADYKDDDDKGLEHHHHHH.

DT382 (V7N V29N S292A)-FLAG-His: Variant 14
(SEQ ID NO: 445):
MGADDVNDSSKSFVMENFSSYHGTKPGYNDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

-continued

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDAETADNLEKTTAALSILPGIGSVMGIADG

AVHHNTEEIVAQSIALSSLMVAQAIPLVGELVDIGFAAYNFVESIINLFQVVHNSYNRPAYSEL

ADYKDDDDKGLEHHHHHH.

DT382 (V7N V29N S292T)-FLAG-His: Variant 15
(SEQ ID NO: 446):
MGADDVNDSSKSFVMENFSSYHGTKPGYNDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDTETADNLEKTTAALSILPGIGSVMGIADG

AVHHNTEEIVAQSIALSSLMVAQAIPLVGELVDIGFAAYNFVESIINLFQVVHNSYNRPAYSEL

ADYKDDDDKGLEHHHHHH.

DT382 (V7N V29T S292T)-FLAG-His: Variant 16
(SEQ ID NO: 447):
MGADDVNDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDTETADNLEKTTAALSILPGIGSVMGIADG

AVHHNTEEIVAQSIALSSLMVAQAIPLVGELVDIGFAAYNFVESIINLFQVVHNSYNRPAYSEL

ADYKDDDDKGLEHHHHHH.

DT382 (V7N V29T I290T)-FLAG-His: Variant 17
(SEQ ID NO: 448):
MGADDVNDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVTDSETADNLEKTTAALSILPGIGSVMGIADG

AVHHNTEEIVAQSIALSSLMVAQAIPLVGELVDIGFAAYNFVESIINLFQVVHNSYNRPAYSEL

ADYKDDDDKGLEHHHHHH.

DT382 (V7N V29T I290N)-FLAG-His: Variant 18
(SEQ ID NO: 449):
MGADDVNDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVNDSETADNLEKTTAALSILPGIGSVMGIADG

AVHHNTEEIVAQSIALSSLMVAQAIPLVGELVDIGFAAYNFVESIINLFQVVHNSYNRPAYSEL

ADYKDDDDKGLEHHHHHH.

DT382 (V7N V29T S292A) (SEQ ID NO: 450):
MGADDVNDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

-continued

EHPELSELKTVTGTNPVFAGANYAAWAVNVAQVIDAETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V29T I290N) (SEQ ID NO: 451):
MGADDVTDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVNDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V29T I290T) (SEQ ID NO: 452):
MGADDVTDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVTDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V29T S292A) (SEQ ID NO: 453):
MGADDVTDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDAETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V29T S292T) (SEQ ID NO: 454):
MGADDVTDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDTETADNLEKTTAALSILPGIGSVMGIADG

AVHHNTEEIVAQSIALSSLMVAQAIPLVGELVDIGFAAYNFVESIINLFQVVHNSYNRPAYS.

DT382 (G53E): Null construct (SEQ ID NO: 455):
MGADDVVDSSKSFVMENFSSYHGTKPGYVDSIQKGIQKPKSGTQGNYDDDWKEFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7S) (SEQ ID NO: 456):
MGADDVSDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

-continued

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T) (SEQ ID NO: 457):
MGADDVTDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N) (SEQ ID NO: 458):
MGADDVNDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7D) (SEQ ID NO: 459):
MGADDVDDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V97A) (SEQ ID NO: 460):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKADNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V97T) (SEQ ID NO: 461):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKTDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V97D) (SEQ ID NO: 462):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKDDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

-continued

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (L107A) (SEQ ID NO: 463):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKEAGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (L107N) (SEQ ID NO: 464):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKENGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M116A) (SEQ ID NO: 465):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLAEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M116Q) (SEQ ID NO: 466):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLQEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M116N) (SEQ ID NO: 467):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLNEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (F124A) (SEQ ID NO: 468):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEAIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

-continued

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (F124H) (SEQ ID NO: 469):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (F124K) (SEQ ID NO: 470):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEKIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V148A) (SEQ ID NO: 471):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSAEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V148T) (SEQ ID NO: 472):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSTEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (L298A) (SEQ ID NO: 473):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNAEKTTAALSILPGIGSVMGIADG

AVHHNTEEIVAQSIALSSLMVAQAIPLVGELVDIGFAAYNFVESIINLFQVVHNSYNRPAYS.

DT382 (L298N) (SEQ ID NO: 474):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNNEKTTAALSILPGIGSVMGIADG

AVHHNTEEIVAQSIALSSLMVAQAIPLVGELVDIGFAAYNFVESIINLFQVVHNSYNRPAYS.

DT382 (V7T F124H) (SEQ ID NO: 475):
MGADDVTDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N F124H) (SEQ ID NO: 476):
MGADDVNDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7D F124H) (SEQ ID NO: 477):
MGADDVDDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T L107A F124H) (SEQ ID NO: 478):
MGADDVTDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKEAGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N L107A F124H) (SEQ ID NO: 479):
MGADDVNDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKEAGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7D L107A F124H) (SEQ ID NO: 480):
MGADDVDDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKEAGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T L107N F124H) (SEQ ID NO: 481):
MGADDVTDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N L107N F124H) (SEQ ID NO: 482):
MGADDVNDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7D L107N F124H) (SEQ ID NO: 483):
MGADDVDDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V97A L107N F124H) (SEQ ID NO: 484):
MGADDVTDSSKSFVMENFSSYHGTKPGYVDSIQKGIQKPKSGTQGNYDDDWKGFYSTDNKYDAA

GYSVDNENPLSGKAGGVVKVTYPGLTKVLALKADNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V97A L107N F124H) (SEQ ID NO: 485):
MGADDVNDSSKSFVMENFSSYHGTKPGYVDSIQKGIQKPKSGTQGNYDDDWKGFYSTDNKYDAA

GYSVDNENPLSGKAGGVVKVTYPGLTKVLALKADNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7D V97A L107N F124H) (SEQ ID NO: 486):
MGADDVDDSSKSFVMENFSSYHGTKPGYVDSIQKGIQKPKSGTQGNYDDDWKGFYSTDNKYDAA

GYSVDNENPLSGKAGGVVKVTYPGLTKVLALKADNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

```
EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V97D L107N F124H) (SEQ ID NO: 487):
MGADDVTDSSKSFVMENFSSYHGTKPGYVDSIQKGIQKPKSGTQGNYDDDWKGFYSTDNKYDAA

GYSVDNENPLSGKAGGVVKVTYPGLTKVLALKDDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V97D L107N F124H) (SEQ ID NO: 488):
MGADDVNDSSKSFVMENFSSYHGTKPGYVDSIQKGIQKPKSGTQGNYDDDWKGFYSTDNKYDAA

GYSVDNENPLSGKAGGVVKVTYPGLTKVLALKDDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7D V97D L107N F124H) (SEQ ID NO: 489):
MGADDVDDSSKSFVMENFSSYHGTKPGYVDSIQKGIQKPKSGTQGNYDDDWKGFYSTDNKYDAA

GYSVDNENPLSGKAGGVVKVTYPGLTKVLALKDDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7T V97T L107N F124H) (SEQ ID NO: 490):
MGADDVTDSSKSFVMENFSSYHGTKPGYVDSIQKGIQKPKSGTQGNYDDDWKGFYSTDNKYDAA

GYSVDNENPLSGKAGGVVKVTYPGLTKVLALKTDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V97T L107N F124H) (SEQ ID NO: 491):
MGADDVNDSSKSFVMENFSSYHGTKPGYVDSIQKGIQKPKSGTQGNYDDDWKGFYSTDNKYDAA

GYSVDNENPLSGKAGGVVKVTYPGLTKVLALKTDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7D V97T L107N F124H) (SEQ ID NO: 492):
MGADDVDDSSKSFVMENFSSYHGTKPGYVDSIQKGIQKPKSGTQGNYDDDWKGFYSTDNKYDAA

GYSVDNENPLSGKAGGVVKVTYPGLTKVLALKTDNAETIKKENGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL
```

DT382 (V7N V29N F124H I290N) (SEQ ID NO: 493):
MGADDVNDSSKSFVMENFSSYHGTKPGYNDSIQKGIQKPKSGTQGNYDDDWKGFYSTDNKYDAA
GYSVDNENPLSGKAGGVVKVTYPGLTKVLALKVDNAETIKKELGLSLTEPLMEQVGTEEHIKRF
GDGASRVVLSLPFAEGSSSVEYINNWEQAKALSVELEINFETRGKRGQDAMYEYMAQACAGNRV
RRSVGSSLSCINLDWDVIRDKTKTKIESLKEHGPIKNKMSESPNKTVSEEKAKQYLEEFHQTAL
EHPELSELKTVTGTNPVFAGANYAAWAVNVAQVNDSETADNLEKTTAALSILPGIGSVMGIADG
AVHHNTEEIVAQSIALSSLMVAQAIPLVGELVDIGFAAYNFVESIINLFQVVHNSYNRPAYS.

DT382 (V7N V29N F124H S292A) (SEQ ID NO: 494):
MGADDVNDSSKSFVMENFSSYHGTKPGYNDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDAETADNLEKTTAALSILPGIGSVMGIADG

AVHHNTEEIVAQSIALSSLMVAQAIPLVGELVDIGFAAYNFVESIINLFQVVHNSYNRPAYS.

DT38 (V7N V29N F124H S292T) (SEQ ID NO: 495):
MGADDVNDSSKSFVMENFSSYHGTKPGYNDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDTETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V29T F124H S292A) (SEQ ID NO: 496):
MGADDVNDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDAETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V29T F124H I290T) (SEQ ID NO: 497):
MGADDVNDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVTDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V29T F124H I290N) (SEQ ID NO: 498):
MGADDVNDSSKSFVMENFSSYHGTKPGYTDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEHIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

-continued

EHPELSELKTVTGTNPVFAGANYAAWAVNVAQVNDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (V7N V29N I290T) (SEQ ID NO: 499):
MGADDVVN DSSKSFVMENFSSYHGTKPGYN DSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVTDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M15I) (SEQ ID NO: 500):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M15D) (SEQ ID NO: 501):
MGADDVVDSSKSFVDENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (T112D) (SEQ ID NO: 502):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLDEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (E117D) (SEQ ID NO: 503):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMDQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (R127A) (SEQ ID NO: 504):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKAF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

-continued

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (S306G) (SEQ ID NO: 505):
MGADDVVDSSKSFVMENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALGILPGIGSVMGIADG

AVHHNTEEIVAQSIALSSLMVAQAIPLVGELVDIGFAAYNFVESIINLFQVVHNSYNRPAYS.

DT382 (M15T V97A) (SEQ ID NO: 506):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKADNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M15T V97T) (SEQ ID NO: 507):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKTDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M15T T112D) (SEQ ID NO: 508):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLDEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M15T E117D) (SEQ ID NO: 509):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMDQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M15T R127A) (SEQ ID NO: 510):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKAF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

-continued

```
EHPELSELKTVTGTNPVFAGANYAAWAVNVAQVIDSETADNLEKTTAALSILPGIGSVMGIADG
AVHHNTEEIVAQSIALSSLMVAQAIPLVGELVDIGFAAYNFVESIINLFQVVHNSYNRPAYS.

DT382 (M15T V148T) (SEQ ID NO: 511):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSTEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSILPGIGSVMGIADG

AVHHNTEEIVAQSIALSSLMVAQAIPLVGELVDIGFAAYNFVESIINLFQVVHNSYNRPAYS.

DT382 (M15T S306G) (SEQ ID NO: 512):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKVDNAETIKKELGLSLTEPLMEQVGTEEFIKRF

GDGASRVVLSLPFAEGSSSVEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALGILPGIGSVMGIADG

AVHHNTEEIVAQSIALSSLMVAQAIPLVGELVDIGFAAYNFVESIINLFQVVHNSYNRPAYS.

DT382 (M15T V97T T112D E117D R127A V148T S306G)
(SEQ ID NO: 513):
MGADDVVDSSKSFVTENFSSYHGTKPGYVDSIQKGIQKPKSGTQGNYDDDWKGFYSTDNKYDAA

GYSVDNENPLSGKAGGVVKVTYPGLTKVLALKTDNAETIKKELGLSLDEPLMDQVGTEEFIKAF

GDGASRVVLSLPFAEGSSSTEYINNWEQAKALSVELEINFETRGKRGQDAMYEYMAQACAGNRV

RRSVGSSLSCINLDWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALGILPGIGSVMGIADG

AVHHNTEEIVAQSIALSSLMVAQAIPLVGELVDIGFAAYNFVESIINLFQVVHNSYNRPAYS.
```

This invention may be embodied in other forms or carried out in other ways without departing from the spirit or essential characteristics thereof. The present disclosure is therefore to be considered as in all aspects illustrated and not restrictive, and all changes which come within the meaning and range of equivalency are intended to be embraced therein.

Various references are cited throughout this specification, each of which is incorporated herein by reference in its entirety.

SEQUENCE LISTING (567 sequences)

SEQ ID NO: 1 - protein, 535 aa, Corynebacterium diphtheriae
GADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 2 - protein, 387 aa, Corynebacterium diphtheriae
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 3 - protein, 133 aa, Artificial Sequence
  Description of Artificial Sequence: Synthetic polypeptide
APTSSSTKKTQLQLEHLLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 4 - protein, 387 aa, Artificial Sequence
  Description of Artificial Sequence: Synthetic polypeptide
MGADDVFDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 5 - protein, 387 aa, Artificial Sequence
  Description of Artificial Sequence: Synthetic polypeptide
MGADDVCDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 6 - protein, 387 aa, Artificial Sequence
  Description of Artificial Sequence: Synthetic polypeptide
MGADDVMDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 7 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 8 - protein, 387 aa, Artificial Sequence
  Description of Artificial Sequence: Synthetic polypeptide
MGADDVWDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 9 - protein, 387 aa, Artificial Sequence
  Description of Artificial Sequence: Synthetic polypeptide
MGADDVYDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 10 - protein, 387 aa, Artificial Sequence
  Description of Artificial Sequence: Synthetic polypeptide
MGADDVPDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 11 - protein, 387 aa, Artificial Sequence
  Description of Artificial Sequence: Synthetic polypeptide
MGADDVHDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 12 - protein, 387 aa, Artificial Sequence
  Description of Artificial Sequence: Synthetic polypeptide
MGADDVEDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 13 - protein, 387 aa, Artificial Sequence
  Description of Artificial Sequence: Synthetic polypeptide
MGADDVQDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 14 - protein, 387 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 15 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 16 - protein, 387 aa, Artificial Sequence
  Description of Artificial Sequence: Synthetic polypeptide
MGADDVKDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 17 - protein, 387 aa, Artificial Sequence
  Description of Artificial Sequence: Synthetic polypeptide
MGADDVRDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 18 - protein, 387 aa, Artificial Sequence
  Description of Artificial Sequence: Synthetic polypeptide
MGADDVVISSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 19 - protein, 387 aa, Artificial Sequence
  Description of Artificial Sequence: Synthetic polypeptide
MGADDVVVSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 20 - protein, 387 aa, Artificial Sequence
  Description of Artificial Sequence: Synthetic polypeptide
MGADDVVLSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 21 - protein, 387 aa, Artificial Sequence
  Description of Artificial Sequence: Synthetic polypeptide
MGADDVVFSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 22 - protein, 387 aa, Artificial Sequence
  Description of Artificial Sequence: Synthetic polypeptide
MGADDVVCSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 23 - protein, 387 aa, Artificial Sequence
  Description of Artificial Sequence: Synthetic polypeptide
MGADDVVMSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 24 - protein, 387 aa, Artificial Sequence
  Description of Artificial Sequence: Synthetic polypeptide
MGADDVVASSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 25 - protein, 387 aa, Artificial Sequence
  Description of Artificial Sequence: Synthetic polypeptide
MGADDVVGSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 26 - protein, 387 aa, Artificial Sequence
  Description of Artificial Sequence: Synthetic polypeptide
MGADDVVTSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 27 - protein, 387 aa, Artificial Sequence
  Description of Artificial Sequence: Synthetic polypeptide
MGADDVVWSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 28 - protein, 387 aa, Artificial Sequence
  Description of Artificial Sequence: Synthetic polypeptide
MGADDVVYSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 29 - protein, 387 aa, Artificial Sequence
  Description of Artificial Sequence: Synthetic polypeptide
MGADDVVPSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 30 - protein, 387 aa, Artificial Sequence
  Description of Artificial Sequence: Synthetic polypeptide
MGADDVVHSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 31 - protein, 387 aa, Artificial Sequence
  Description of Artificial Sequence: Synthetic polypeptide
MGADDVVQSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 32 - protein, 387 aa, Artificial Sequence
  Description of Artificial Sequence: Synthetic polypeptide
MGADDVVNSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 33 - protein, 387 aa, Artificial Sequence
  Description of Artificial Sequence: Synthetic polypeptide
MGADDVVKSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 34 - protein, 387 aa, Artificial Sequence
  Description of Artificial Sequence: Synthetic polypeptide
MGADDVVRSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 35 - protein, 387 aa, Artificial Sequence
  Description of Artificial Sequence: Synthetic polypeptide
MGADDVVDISKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 36 - protein, 387 aa, Artificial Sequence
  Description of Artificial Sequence: Synthetic polypeptide
MGADDVVDFSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 37 - protein, 387 aa, Artificial Sequence
  Description of Artificial Sequence: Synthetic polypeptide
MGADDVVDCSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 38 - protein, 387 aa, Artificial Sequence
  Description of Artificial Sequence: Synthetic polypeptide
MGADDVVDMSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 39 - protein, 387 aa, Artificial Sequence
  Description of Artificial Sequence: Synthetic polypeptide
MGADDVVDASKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 40 - protein, 387 aa, Artificial Sequence
  Description of Artificial Sequence: Synthetic polypeptide
MGADDVVDGSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 41 - protein, 387 aa, Artificial Sequence
  Description of Artificial Sequence: Synthetic polypeptide
MGADDVVDTSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 42 - protein, 387 aa, Artificial Sequence
  Description of Artificial Sequence: Synthetic polypeptide
MGADDVVDWSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 43 - protein, 387 aa, Artificial Sequence
  Description of Artificial Sequence: Synthetic polypeptide
MGADDVVDYSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 44 - protein, 387 aa, Artificial Sequence
  Description of Artificial Sequence: Synthetic polypeptide
MGADDVVDPSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 45 - protein, 387 aa, Artificial Sequence
  Description of Artificial Sequence: Synthetic polypeptide
MGADDVVDHSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 46 - protein, 387 aa, Artificial Sequence
  Description of Artificial Sequence: Synthetic polypeptide
MGADDVVDESKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 47 - protein, 387 aa, Artificial Sequence
  Description of Artificial Sequence: Synthetic polypeptide
MGADDVVDQSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 48 - protein, 387 aa, Artificial Sequence
  Description of Artificial Sequence: Synthetic polypeptide
MGADDVVDDSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 49 - protein, 387 aa, Artificial Sequence
  Description of Artificial Sequence: Synthetic polypeptide
MGADDVVDNSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 50 - protein, 387 aa, Artificial Sequence
  Description of Artificial Sequence: Synthetic polypeptide
MGADDVVDKSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 51 - protein, 387 aa, Artificial Sequence
  Description of Artificial Sequence: Synthetic polypeptide
MGADDVVDRSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 52 - protein, 387 aa, Artificial Sequence
  Description of Artificial Sequence: Synthetic polypeptide
MGADDVVDSSKSFVMENFSSYHGTKPGYFDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 53 - protein, 387 aa, Artificial Sequence
  Description of Artificial Sequence: Synthetic polypeptide
MGADDVVDSSKSFVMENFSSYHGTKPGYCDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 54 - protein, 387 aa, Artificial Sequence
  Description of Artificial Sequence: Synthetic polypeptide
MGADDVVDSSKSFVMENFSSYHGTKPGYMDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 55 - protein, 387 aa, Artificial Sequence
  Description of Artificial Sequence: Synthetic polypeptide
MGADDVVDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 56 - protein, 387 aa, Artificial Sequence
  Description of Artificial Sequence: Synthetic polypeptide
MGADDVVDSSKSFVMENFSSYHGTKPGYWDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 57 - protein, 387 aa, Artificial Sequence
  Description of Artificial Sequence: Synthetic polypeptide
MGADDVVDSSKSFVMENFSSYHGTKPGYYDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 58 - protein, 387 aa, Artificial Sequence
  Description of Artificial Sequence: Synthetic polypeptide
MGADDVVDSSKSFVMENFSSYHGTKPGYPDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 59 - protein, 387 aa, Artificial Sequence
  Description of Artificial Sequence: Synthetic polypeptide
MGADDVVDSSKSFVMENFSSYHGTKPGYHDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 60 - protein, 387 aa, Artificial Sequence
  Description of Artificial Sequence: Synthetic polypeptide
MGADDVVDSSKSFVMENFSSYHGTKPGYEDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 61 - protein, 387 aa, Artificial Sequence
  Description of Artificial Sequence: Synthetic polypeptide
MGADDVVDSSKSFVMENFSSYHGTKPGYQDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 62 - protein, 387 aa, Artificial Sequence
  Description of Artificial Sequence: Synthetic polypeptide
MGADDVVDSSKSFVMENFSSYHGTKPGYDDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 63 - protein, 387 aa, Artificial Sequence
  Description of Artificial Sequence: Synthetic polypeptide
MGADDVVDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 64 - protein, 387 aa, Artificial Sequence
  Description of Artificial Sequence: Synthetic polypeptide
MGADDVVDSSKSFVMENFSSYHGTKPGYKDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 65 - protein, 387 aa, Artificial Sequence
  Description of Artificial Sequence: Synthetic polypeptide
MGADDVVDSSKSFVMENFSSYHGTKPGYRDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 66 - protein, 387 aa, Artificial Sequence
  Description of Artificial Sequence: Synthetic polypeptide
MGADDVVDSSKSFVMENFSSYHGTKPGYVISIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 67 - protein, 387 aa, Artificial Sequence
  Description of Artificial Sequence: Synthetic polypeptide
MGADDVVDSSKSFVMENFSSYHGTKPGYVVSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 68 - protein, 387 aa, Artificial Sequence
  Description of Artificial Sequence: Synthetic polypeptide
MGADDVVDSSKSFVMENFSSYHGTKPGYVLSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 69 - protein, 387 aa, Artificial Sequence
  Description of Artificial Sequence: Synthetic polypeptide
MGADDVVDSSKSFVMENFSSYHGTKPGYVFSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 70 - protein, 387 aa, Artificial Sequence
  Description of Artificial Sequence: Synthetic polypeptide
MGADDVVDSSKSFVMENFSSYHGTKPGYVCSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 71 - protein, 387 aa, Artificial Sequence
  Description of Artificial Sequence: Synthetic polypeptide
MGADDVVDSSKSFVMENFSSYHGTKPGYVMSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 72 - protein, 387 aa, Artificial Sequence
  Description of Artificial Sequence: Synthetic polypeptide
MGADDVVDSSKSFVMENFSSYHGTKPGYVASIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 73 - protein, 387 aa, Artificial Sequence
  Description of Artificial Sequence: Synthetic polypeptide
MGADDVVDSSKSFVMENFSSYHGTKPGYVGSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 74 - protein, 387 aa, Artificial Sequence
  Description of Artificial Sequence: Synthetic polypeptide
MGADDVVDSSKSFVMENFSSYHGTKPGYVTSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 75 - protein, 387 aa, Artificial Sequence
  Description of Artificial Sequence: Synthetic polypeptide
MGADDVVDSSKSFVMENFSSYHGTKPGYVWSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 76 - protein, 387 aa, Artificial Sequence
  Description of Artificial Sequence: Synthetic polypeptide
MGADDVVDSSKSFVMENFSSYHGTKPGYVYSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 77 - protein, 387 aa, Artificial Sequence
  Description of Artificial Sequence: Synthetic polypeptide
MGADDVVDSSKSFVMENFSSYHGTKPGYVPSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 78 - protein, 387 aa, Artificial Sequence
  Description of Artificial Sequence: Synthetic polypeptide
MGADDVVDSSKSFVMENFSSYHGTKPGYVHSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 79 - protein, 387 aa, Artificial Sequence
  Description of Artificial Sequence: Synthetic polypeptide
MGADDVVDSSKSFVMENFSSYHGTKPGYVQSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 80 - protein, 387 aa, Artificial Sequence
  Description of Artificial Sequence: Synthetic polypeptide
MGADDVVDSSKSFVMENFSSYHGTKPGYVNSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 81 - protein, 387 aa, Artificial Sequence
  Description of Artificial Sequence: Synthetic polypeptide
MGADDVVDSSKSFVMENFSSYHGTKPGYVKSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 82 - protein, 387 aa, Artificial Sequence
  Description of Artificial Sequence: Synthetic polypeptide
MGADDVVDSSKSFVMENFSSYHGTKPGYVRSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 83 - protein, 387 aa, Artificial Sequence
  Description of Artificial Sequence: Synthetic polypeptide
MGADDVVDSSKSFVMENFSSYHGTKPGYVDIIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 84 - protein, 387 aa, Artificial Sequence
  Description of Artificial Sequence: Synthetic polypeptide
MGADDVVDSSKSFVMENFSSYHGTKPGYVDFIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 85 - protein, 387 aa, Artificial Sequence
  Description of Artificial Sequence: Synthetic polypeptide
MGADDVVDSSKSFVMENFSSYHGTKPGYVDCIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 86 - protein, 387 aa, Artificial Sequence
  Description of Artificial Sequence: Synthetic polypeptide
MGADDVVDSSKSFVMENFSSYHGTKPGYVDMIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 87 - protein, 387 aa, Artificial Sequence
  Description of Artificial Sequence: Synthetic polypeptide
MGADDVVDSSKSFVMENFSSYHGTKPGYVDAIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 88 - protein, 387 aa, Artificial Sequence
  Description of Artificial Sequence: Synthetic polypeptide
MGADDVVDSSKSFVMENFSSYHGTKPGYVDGIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 89 - protein, 387 aa, Artificial Sequence
  Description of Artificial Sequence: Synthetic polypeptide
MGADDVVDSSKSFVMENFSSYHGTKPGYVDTIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 90 - protein, 387 aa, Artificial Sequence
  Description of Artificial Sequence: Synthetic polypeptide
MGADDVVDSSKSFVMENFSSYHGTKPGYVDWIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 91 - protein, 387 aa, Artificial Sequence
  Description of Artificial Sequence: Synthetic polypeptide
MGADDVVDSSKSFVMENFSSYHGTKPGYVDYIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 92 - protein, 387 aa, Artificial Sequence
  Description of Artificial Sequence: Synthetic polypeptide
MGADDVVDSSKSFVMENFSSYHGTKPGYVDPIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 93 - protein, 387 aa, Artificial Sequence
  Description of Artificial Sequence: Synthetic polypeptide
MGADDVVDSSKSFVMENFSSYHGTKPGYVDHIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 94 - protein, 387 aa, Artificial Sequence
  Description of Artificial Sequence: Synthetic polypeptide
MGADDVVDSSKSFVMENFSSYHGTKPGYVDEIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 95 - protein, 387 aa, Artificial Sequence
  Description of Artificial Sequence: Synthetic polypeptide
MGADDVVDSSKSFVMENFSSYHGTKPGYVDQIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 96 - protein, 387 aa, Artificial Sequence
  Description of Artificial Sequence: Synthetic polypeptide
MGADDVVDSSKSFVMENFSSYHGTKPGYVDDIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 97 - protein, 387 aa, Artificial Sequence
  Description of Artificial Sequence: Synthetic polypeptide
MGADDVVDSSKSFVMENFSSYHGTKPGYVDNIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 98 - protein, 387 aa, Artificial Sequence
  Description of Artificial Sequence: Synthetic polypeptide
MGADDVVDSSKSFVMENFSSYHGTKPGYVDKIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 99 - protein, 387 aa, Artificial Sequence
  Description of Artificial Sequence: Synthetic polypeptide
MGADDVVDSSKSFVMENFSSYHGTKPGYVDRIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 100 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVFDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 101 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVCDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 102 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVMDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 103 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 104 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVWDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 105 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVYDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 106 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVPDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 107 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVHDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 108 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVEDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 109 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVQDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 110 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVDDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 111 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVNDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 112 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVKDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 113 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVRDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 114 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIISETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 115 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIVSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 116 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVILSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 117 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIFSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 118 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVICSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 119 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIMSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 120 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIASETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 121 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIGSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 122 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVITSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 123 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIWSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 124 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIYSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 125 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIPSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 126 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIHSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 127 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIQSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 128 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVINSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 129 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIKSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 130 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIRSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 131 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDIETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 132 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDFETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 133 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDCETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 134 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDMETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 135 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 136 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDGETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 137 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDTETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 138 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDWETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 139 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDYETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 140 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDPETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 141 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDHETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 142 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDEETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 143 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDQETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 144 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDDETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 145 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDNETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 146 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDKETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 147 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDRETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 148 - protein, 521 aa, Corynebacterium diphtheriae
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTHAPTSSSTKKTQLQLEHLLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 149 - protein, 387 aa, Artificial Sequence
  Description of Artificial Sequence: Synthetic polypeptide
MGADDVADSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 150 - protein, 387 aa, Artificial Sequence
  Description of Artificial Sequence: Synthetic polypeptide
MGADDVSDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 151 - protein, 387 aa, Artificial Sequence
  Description of Artificial Sequence: Synthetic polypeptide
MGADDVVSSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 152 - protein, 387 aa, Artificial Sequence
  Description of Artificial Sequence: Synthetic polypeptide
MGADDVVDSSKSFVMENFSSYHGTKPGYADSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 153 - protein, 387 aa, Artificial Sequence
  Description of Artificial Sequence: Synthetic polypeptide
MGADDVVDSSKSFVMENFSSYHGTKPGYSDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 154 - protein, 387 aa, Artificial Sequence
  Description of Artificial Sequence: Synthetic polypeptide
MGADDVVDSSKSFVMENFSSYHGTKPGYVSSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 155 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVADSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 156 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVSDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 157 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVISSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 158 - protein, 15 aa, Artificial Sequence
  Description of Artificial Sequence: Synthetic peptide
MGADDVVDSSKSFVM

SEQ ID NO: 159 - protein, 15 aa, Artificial Sequence
  Description of Artificial Sequence: Synthetic peptide
DDVVDSSKSFVMENF

SEQ ID NO: 160 - protein, 15 aa, Artificial Sequence
  Description of Artificial Sequence: Synthetic peptide
VDSSKSFVMENFSSY

SEQ ID NO: 161 - protein, 9 aa, Artificial Sequence
  Description of Artificial Sequence: Synthetic peptide
VDSSKSFVM

SEQ ID NO: 162 - protein, 15 aa, Artificial Sequence
  Description of Artificial Sequence: Synthetic peptide
KVLALKVDNAETIKK

SEQ ID NO: 163 - protein, 15 aa, Artificial Sequence
  Description of Artificial Sequence: Synthetic peptide
ALKVDNAETIKKELG

SEQ ID NO: 164 - protein, 9 aa, Artificial Sequence
  Description of Artificial Sequence: Synthetic peptide
VDNAETIKK

SEQ ID NO: 165 - protein, 18 aa, Artificial Sequence
  Description of Artificial Sequence: Synthetic peptide
AETIKKELGLSLTEPLME

SEQ ID NO: 166 - protein, 15 aa, Artificial Sequence
  Description of Artificial Sequence: Synthetic peptide
IKKELGLSLTEPLME

SEQ ID NO: 167 - protein, 9 aa, Artificial Sequence
  Description of Artificial Sequence: Synthetic peptide
LGLSLTEPL

SEQ ID NO: 168 - protein, 15 aa, Artificial Sequence
  Description of Artificial Sequence: Synthetic peptide
LMEQVGTEEFIKRFG

SEQ ID NO: 169 - protein, 9 aa, Artificial Sequence
  Description of Artificial Sequence: Synthetic peptide
MEQVGTEEF

SEQ ID NO: 170 - protein, 15 aa, Artificial Sequence
  Description of Artificial Sequence: Synthetic peptide
QVGTEEFIKRFGDGA

SEQ ID NO: 171 - protein, 15 aa, Artificial Sequence
  Description of Artificial Sequence: Synthetic peptide
TEEFIKRFGDGASRV

SEQ ID NO: 172 - protein, 15 aa, Artificial Sequence
  Description of Artificial Sequence: Synthetic peptide
FIKRFGDGASRVVLS

SEQ ID NO: 173 - protein, 9 aa, Artificial Sequence
  Description of Artificial Sequence: Synthetic peptide
FIKRFGDGA

SEQ ID NO: 174 - protein, 15 aa, Artificial Sequence
  Description of Artificial Sequence: Synthetic peptide
SSSVEYINNWEQAKA

SEQ ID NO: 175 - protein, 9 aa, Artificial Sequence
  Description of Artificial Sequence: Synthetic peptide
VEYINNWEQ

SEQ ID NO: 176 - protein, 15 aa, Artificial Sequence
  Description of Artificial Sequence: Synthetic peptide
ADNLEKTTAALSILP

SEQ ID NO: 177 - protein, 15 aa, Artificial Sequence
  Description of Artificial Sequence: Synthetic peptide
LEKTTAALSILPGIG

SEQ ID NO: 178 - protein, 9 aa, Artificial Sequence
  Description of Artificial Sequence: Synthetic peptide
LEKTTAALS

SEQ ID NO: 179 - protein, 6 aa, Artificial Sequence
  Description of Artificial Sequence: Synthetic peptide
MGADDV

SEQ ID NO: 180 - protein, 9 aa, Artificial Sequence
  Description of Artificial Sequence: Synthetic peptide
ENFSSYHGT

SEQ ID NO: 181 - protein, 27 aa, Artificial Sequence
  Description of Artificial Sequence: Synthetic peptide
MGADDVVDSSKSFVMENFSSYHGTKPG

SEQ ID NO: 182 - protein, 9 aa, Artificial Sequence
  Description of Artificial Sequence: Synthetic peptide
GLTKVLALK

SEQ ID NO: 183 - protein, 9 aa, Artificial Sequence
  Description of Artificial Sequence: Synthetic peptide
ELGLSLTEP

SEQ ID NO: 184 - protein, 33 aa, Artificial Sequence
  Description of Artificial Sequence: Synthetic polypeptide
TYPGLTKVLALKVDNAETIKKELGLSLTEPLME

SEQ ID NO: 185 - protein, 9 aa, Artificial Sequence
  Description of Artificial Sequence: Synthetic peptide
DNAETIKKE

SEQ ID NO: 186 - protein, 9 aa, Artificial Sequence
  Description of Artificial Sequence: Synthetic peptide
MEQVGTEEF

SEQ ID NO: 187 - protein, 33 aa, Artificial Sequence
  Description of Artificial Sequence: Synthetic polypeptide
LKVDNAETIKKELGLSLTEPLMEQVGTEEFIKR

SEQ ID NO: 188 - protein, 9 aa, Artificial Sequence
  Description of Artificial Sequence: Synthetic peptide
LGLSLTEPL

SEQ ID NO: 189 - protein, 9 aa, Artificial Sequence
  Description of Artificial Sequence: Synthetic peptide
IKRFGDGAS

SEQ ID NO: 190 - protein, 33 aa, Artificial Sequence
  Description of Artificial Sequence: Synthetic polypeptide
KKELGLSLTEPLMEQVGTEEFIKRFGDGASRVV

SEQ ID NO: 191 - protein, 9 aa, Artificial Sequence
  Description of Artificial Sequence: Synthetic peptide
LMEQVGTEE

SEQ ID NO: 192 - protein, 9 aa, Artificial Sequence
  Description of Artificial Sequence: Synthetic peptide
SRVVLSLPF

SEQ ID NO: 193 - protein, 33 aa, Artificial Sequence
  Description of Artificial Sequence: Synthetic polypeptide
TEPLMEQVGTEEFIKRFGDGASRVVLSLPFAEG

SEQ ID NO: 194 - protein, 9 aa, Artificial Sequence
  Description of Artificial Sequence: Synthetic peptide
LPFAEGSSS

SEQ ID NO: 195 - protein, 9 aa, Artificial Sequence
  Description of Artificial Sequence: Synthetic peptide
AKALSVELE

SEQ ID NO: 196 - protein, 33 aa, Artificial Sequence
  Description of Artificial Sequence: Synthetic polypeptide
VLSLPFAEGSSSVEYINNWEQAKALSVELEINF

SEQ ID NO: 197 - protein, 9 aa, Artificial Sequence
  Description of Artificial Sequence: Synthetic peptide
VIDSETADN

SEQ ID NO: 198 - protein, 9 aa, Artificial Sequence
  Description of Artificial Sequence: Synthetic peptide
ILPGIGSVM

SEQ ID NO: 199 - protein, 33 aa, Artificial Sequence
  Description of Artificial Sequence: Synthetic polypeptide
VAQVIDSETADNLEKTTAALSILPGIGSVMGIA

SEQ ID NO: 200 - protein, 389 aa, Corynebacterium diphtheriae
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTHA

SEQ ID NO: 201 - protein, 12 aa, Influenza virus
PKYVKQNTLKLA

SEQ ID NO: 202 - protein, 15 aa, Chlamydia sp.
KVVDQIKKISKPVQH

SEQ ID NO: 203 - protein, 9 aa, Artificial Sequence
  Description of Artificial Sequence: Synthetic peptide
MGADDVVDS

SEQ ID NO: 204 - protein, 9 aa, Artificial Sequence
  Description of Artificial Sequence: Synthetic peptide
VVDSSKSFV

SEQ ID NO: 205 - protein, 9 aa, Artificial Sequence
  Description of Artificial Sequence: Synthetic peptide
VDSSKSFVM

SEQ ID NO: 206 - protein, 9 aa, Artificial Sequence
  Description of Artificial Sequence: Synthetic peptide
MENFSSYHG

SEQ ID NO: 207 - protein, 9 aa, Artificial Sequence
  Description of Artificial Sequence: Synthetic peptide
VDSIQKGIQ

SEQ ID NO: 208 - protein, 9 aa, Artificial Sequence
  Description of Artificial Sequence: Synthetic peptide
LTKVLALKV

SEQ ID NO: 209 - protein, 9 aa, Artificial Sequence
  Description of Artificial Sequence: Synthetic peptide
VDNAETIKK

SEQ ID NO: 210 - protein, 9 aa, Artificial Sequence
  Description of Artificial Sequence: Synthetic peptide
LGLSLTEPL

SEQ ID NO: 211 - protein, 9 aa, Artificial Sequence
  Description of Artificial Sequence: Synthetic peptide
MEQVGTEEF

SEQ ID NO: 212 - protein, 9 aa, Artificial Sequence
  Description of Artificial Sequence: Synthetic peptide
VEYINNWEQ

SEQ ID NO: 213 - protein, 9 aa, Artificial Sequence
  Description of Artificial Sequence: Synthetic peptide
WEQAKALSV

SEQ ID NO: 214 - protein, 9 aa, Artificial Sequence
  Description of Artificial Sequence: Synthetic peptide
MYEYMAQAC

SEQ ID NO: 215 - protein, 9 aa, Artificial Sequence
  Description of Artificial Sequence: Synthetic peptide
IRDKTKTKI

SEQ ID NO: 216 - protein, 9 aa, Artificial Sequence
  Description of Artificial Sequence: Synthetic peptide
LKEHGPIKN

SEQ ID NO: 217 - protein, 9 aa, Artificial Sequence
  Description of Artificial Sequence: Synthetic peptide
LSELKTVTG

SEQ ID NO: 218 - protein, 9 aa, Artificial Sequence
  Description of Artificial Sequence: Synthetic peptide
VNVAQVIDS

SEQ ID NO: 219 - protein, 9 aa, Artificial Sequence
  Description of Artificial Sequence: Synthetic peptide
VIDSETADN

SEQ ID NO: 220 - protein, 9 aa, Artificial Sequence
  Description of Artificial Sequence: Synthetic peptide
LEKTTAALS

SEQ ID NO: 221 - protein, 9 aa, Artificial Sequence
  Description of Artificial Sequence: Synthetic peptide
LSILPGIGS

SEQ ID NO: 222 - protein, 9 aa, Artificial Sequence
  Description of Artificial Sequence: Synthetic peptide
LPGIGSVMG

SEQ ID NO: 223 - protein, 9 aa, Artificial Sequence
  Description of Artificial Sequence: Synthetic peptide
IVAQSIALS

SEQ ID NO: 224 - protein, 9 aa, Artificial Sequence
  Description of Artificial Sequence: Synthetic peptide
VAQSIALSS

SEQ ID NO: 225 - protein, 9 aa, Artificial Sequence
  Description of Artificial Sequence: Synthetic peptide
IALSSLMVA

SEQ ID NO: 226 - protein, 9 aa, Artificial Sequence
  Description of Artificial Sequence: Synthetic peptide
LSSLMVAQA

SEQ ID NO: 227 - protein, 9 aa, Artificial Sequence
  Description of Artificial Sequence: Synthetic peptide
LMVAQAIPL

SEQ ID NO: 228 - protein, 9 aa, Artificial Sequence
  Description of Artificial Sequence: Synthetic peptide
MVAQAIPLV

SEQ ID NO: 229 - protein, 9 aa, Artificial Sequence
  Description of Artificial Sequence: Synthetic peptide
VAQAIPLVG

SEQ ID NO: 230 - protein, 9 aa, Artificial Sequence
  Description of Artificial Sequence: Synthetic peptide
VESIINLFQ

SEQ ID NO: 231 - protein, 9 aa, Artificial Sequence
  Description of Artificial Sequence: Synthetic peptide
IINLFQVVH

SEQ ID NO: 232 - protein, 9 aa, Artificial Sequence
  Description of Artificial Sequence: Synthetic peptide
INLFQVVHN

SEQ ID NO: 233 - protein, 9 aa, Artificial Sequence
  Description of Artificial Sequence: Synthetic peptide
VHNSYNRPA

SEQ ID NO: 234 - protein, 387 aa, Artificial Sequence
  Description of Artificial Sequence: Synthetic polypeptide
MGADDVGDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 235 - protein, 387 aa, Artificial Sequence
  Description of Artificial Sequence: Synthetic polypeptide
MGADDVVDSSKSFVMENFSSYHGTKPGYGDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 236 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVGDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 237 - protein, 387 aa, Artificial Sequence
  Description of Artificial Sequence: Synthetic polypeptide
MGADDVLDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 238 - protein, 387 aa, Artificial Sequence
  Description of Artificial Sequence: Synthetic polypeptide
MGADDVVDSSKSFVMENFSSYHGTKPGYLDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 239 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVLDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 240 - protein, 387 aa, Artificial Sequence
  Description of Artificial Sequence: Synthetic polypeptide
MGADDVVDLSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 241 - protein, 387 aa, Artificial Sequence
  Description of Artificial Sequence: Synthetic polypeptide
MGADDVVDSSKSFVMENFSSYHGTKPGYVDLIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 242 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDLETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 243 - protein, 387 aa, Artificial Sequence
  Description of Artificial Sequence: Synthetic polypeptide
MGADDVVDVSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 244 - protein, 387 aa, Artificial Sequence
  Description of Artificial Sequence: Synthetic polypeptide
MGADDVVDSSKSFVMENFSSYHGTKPGYVDVIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 245 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDVETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 246 - protein, 387 aa, Artificial Sequence
  Description of Artificial Sequence: Synthetic polypeptide
MGADDVVESSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 247 - protein, 387 aa, Artificial Sequence
  Description of Artificial Sequence: Synthetic polypeptide
MGADDVVDSSKSFVMENFSSYHGTKPGYVESIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 248 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIESETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 249 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 250 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 251 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKENGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 252 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLAEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 253 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLQEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 254 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLNEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 255 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 256 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSAEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 257 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 258 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNAEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 259 - protein, 387 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNNEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 260 - protein, 387 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 261 - protein, 387 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 262 - protein, 387 aa, Artificial Sequence
  Description of Artificial Sequence: Synthetic polypeptide
MGADDVNDSSKSFVMENFSSYHGTKPGYDDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 263 - protein, 387 aa, Artificial Sequence
  Description of Artificial Sequence: Synthetic polypeptide
MGADDVTDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 264 - protein, 387 aa, Artificial Sequence
  Description of Artificial Sequence: Synthetic polypeptide
MGADDVTDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 265 - protein, 387 aa, Artificial Sequence; identical to SEQ ID NO: 7
  Description of Artificial Sequence: Synthetic polypeptide

SEQ ID NO: 266 - protein, 387 aa, Artificial Sequence; identical to SEQ ID NO: 2
  Description of Artificial Sequence: Synthetic polypeptide

SEQ ID NO: 267 - protein, 387 aa, Artificial Sequence; identical to SEQ ID NO: 2
  Description of Artificial Sequence: Synthetic polypeptide

SEQ ID NO: 268 - protein, 387 aa, Artificial Sequence; identical to SEQ ID NO: 2
  Description of Artificial Sequence: Synthetic polypeptide

SEQ ID NO: 269 - protein, 387 aa, Artificial Sequence; identical to SEQ ID NO: 2
  Description of Artificial Sequence: Synthetic polypeptide

SEQ ID NO: 270 - protein, 387 aa, Artificial Sequence; identical to SEQ ID NO: 2
  Description of Artificial Sequence: Synthetic polypeptide

SEQ ID NO: 271 - protein, 387 aa, Artificial Sequence; identical to SEQ ID NO: 2
  Description of Artificial Sequence: Synthetic polypeptide

SEQ ID NO: 272 - protein, 387 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVNDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 273 - protein, 387 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 274 - protein, 387 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 275 - protein, 387 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDTETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 276 - protein, 387 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVNDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 277 - protein, 387 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 278 - protein, 387 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 279 - protein, 387 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDTETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 280 - protein, 387 aa, Artificial Sequence
  Description of Artificial Sequence: Synthetic polypeptide
MGADDVTDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 281 - protein, 387 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 282 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 283 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKADNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 284 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 285 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 286 - protein, 387 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKADNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 287 - protein, 387 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 288 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKADNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 289 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 290 - protein, 15 aa, Artificial Sequence
  Description of Artificial Sequence: Synthetic peptide
SKSFVMENFSSYHGT

SEQ ID NO: 291 - protein, 15 aa, Artificial Sequence
  Description of Artificial Sequence: Synthetic peptide
FVMENFSSYHGTKPG

SEQ ID NO: 292 - protein, 15 aa, Artificial Sequence
  Description of Artificial Sequence: Synthetic peptide
ENFSSYHGTKPGYVD

SEQ ID NO: 293 - protein, 15 aa, Artificial Sequence
  Description of Artificial Sequence: Synthetic peptide
SSYHGTKPGYVDSIQ

SEQ ID NO: 294 - protein, 15 aa, Artificial Sequence
  Description of Artificial Sequence: Synthetic peptide
HGTKPGYVDSIQKGI

SEQ ID NO: 295 - protein, 15 aa, Artificial Sequence
  Description of Artificial Sequence: Synthetic peptide
KPGYVDSIQKGIQKP

SEQ ID NO: 296 - protein, 15 aa, Artificial Sequence
  Description of Artificial Sequence: Synthetic peptide
YVDSIQKGIQKPKSG

SEQ ID NO: 297 - protein, 15 aa, Artificial Sequence
  Description of Artificial Sequence: Synthetic peptide
SIQKGIQKPKSGTQG

SEQ ID NO: 298 - protein, 15 aa, Artificial Sequence
  Description of Artificial Sequence: Synthetic peptide
KGIQKPKSGTQGNYD

SEQ ID NO: 299 - protein, 15 aa, Artificial Sequence
  Description of Artificial Sequence: Synthetic peptide
QKPKSGTQGNYDDDW

SEQ ID NO: 300 - protein, 15 aa, Artificial Sequence
  Description of Artificial Sequence: Synthetic peptide
KSGTQGNYDDDWKGF

SEQ ID NO: 301 - protein, 15 aa, Artificial Sequence
  Description of Artificial Sequence: Synthetic peptide
TQGNYDDDWKGFYST

SEQ ID NO: 302 - protein, 15 aa, Artificial Sequence
  Description of Artificial Sequence: Synthetic peptide
NYDDDWKGFYSTDNK

SEQ ID NO: 303 - protein, 15 aa, Artificial Sequence
  Description of Artificial Sequence: Synthetic peptide
DDWKGFYSTDNKYDA

SEQ ID NO: 304 - protein, 15 aa, Artificial Sequence
  Description of Artificial Sequence: Synthetic peptide
KGFYSTDNKYDAAGY

SEQ ID NO: 305 - protein, 15 aa, Artificial Sequence
  Description of Artificial Sequence: Synthetic peptide
YSTDNKYDAAGYSVD

SEQ ID NO: 306 - protein, 15 aa, Artificial Sequence
  Description of Artificial Sequence: Synthetic peptide
DNKYDAAGYSVDNEN

SEQ ID NO: 307 - protein, 15 aa, Artificial Sequence
  Description of Artificial Sequence: Synthetic peptide
YDAAGYSVDNENPLS

SEQ ID NO: 308 - protein, 15 aa, Artificial Sequence
  Description of Artificial Sequence: Synthetic peptide
AGYSVDNENPLSGKA

SEQ ID NO: 309 - protein, 15 aa, Artificial Sequence
  Description of Artificial Sequence: Synthetic peptide
SVDNENPLSGKAGGV

SEQ ID NO: 310 - protein, 15 aa, Artificial Sequence
  Description of Artificial Sequence: Synthetic peptide
NENPLSGKAGGVVKV

SEQ ID NO: 311 - protein, 15 aa, Artificial Sequence
  Description of Artificial Sequence: Synthetic peptide
PLSGKAGGVVKVTYP

SEQ ID NO: 312 - protein, 15 aa, Artificial Sequence
  Description of Artificial Sequence: Synthetic peptide
GKAGGVVKVTYPGLT

SEQ ID NO: 313 - protein, 15 aa, Artificial Sequence
  Description of Artificial Sequence: Synthetic peptide
GGVVKVTYPGLTKVL

SEQ ID NO: 314 - protein, 15 aa, Artificial Sequence
  Description of Artificial Sequence: Synthetic peptide
VKVTYPGLTKVLALK

SEQ ID NO: 315 - protein, 15 aa, Artificial Sequence
  Description of Artificial Sequence: Synthetic peptide
TYPGLTKVLALKVDN

SEQ ID NO: 316 - protein, 15 aa, Artificial Sequence
  Description of Artificial Sequence: Synthetic peptide
GLTKVLALKVDNAET

SEQ ID NO: 317 - protein, 15 aa, Artificial Sequence
  Description of Artificial Sequence: Synthetic peptide
VDNAETIKKELGLSL

SEQ ID NO: 318 - protein, 15 aa, Artificial Sequence
  Description of Artificial Sequence: Synthetic peptide
AETIKKELGLSLTEP

SEQ ID NO: 319 - protein, 15 aa, Artificial Sequence
  Description of Artificial Sequence: Synthetic peptide
ELGLSLTEPLMEQVG

SEQ ID NO: 320 - protein, 15 aa, Artificial Sequence
  Description of Artificial Sequence: Synthetic peptide
LSLTEPLMEQVGTEE

SEQ ID NO: 321 - protein, 15 aa, Artificial Sequence
  Description of Artificial Sequence: Synthetic peptide
TEPLMEQVGTEEFIK

SEQ ID NO: 322 - protein, 15 aa, Artificial Sequence
  Description of Artificial Sequence: Synthetic peptide
RFGDGASRVVLSLPF

SEQ ID NO: 323 - protein, 15 aa, Artificial Sequence
  Description of Artificial Sequence: Synthetic peptide
DGASRVVLSLPFAEG

SEQ ID NO: 324 - protein, 15 aa, Artificial Sequence
  Description of Artificial Sequence: Synthetic peptide
SRVVLSLPFAEGSSS

SEQ ID NO: 325 - protein, 15 aa, Artificial Sequence
  Description of Artificial Sequence: Synthetic peptide
VLSLPFAEGSSSVEY

SEQ ID NO: 326 - protein, 15 aa, Artificial Sequence
  Description of Artificial Sequence: Synthetic peptide
LPFAEGSSSVEYINN

SEQ ID NO: 327 - protein, 15 aa, Artificial Sequence
  Description of Artificial Sequence: Synthetic peptide
AEGSSSVEYINNWEQ

SEQ ID NO: 328 - protein, 15 aa, Artificial Sequence
  Description of Artificial Sequence: Synthetic peptide
VEYINNWEQAKALSV

SEQ ID NO: 329 - protein, 15 aa, Artificial Sequence
  Description of Artificial Sequence: Synthetic peptide
INNWEQAKALSVELE

SEQ ID NO: 330 - protein, 15 aa, Artificial Sequence
  Description of Artificial Sequence: Synthetic peptide
WEQAKALSVELEINF

SEQ ID NO: 331 - protein, 15 aa, Artificial Sequence
  Description of Artificial Sequence: Synthetic peptide
AKALSVELEINFETR

SEQ ID NO: 332 - protein, 15 aa, Artificial Sequence
  Description of Artificial Sequence: Synthetic peptide
LSVELEINFETRGKR

SEQ ID NO: 333 - protein, 15 aa, Artificial Sequence
  Description of Artificial Sequence: Synthetic peptide
ELEINFETRGKRGQD

SEQ ID NO: 334 - protein, 15 aa, Artificial Sequence
  Description of Artificial Sequence: Synthetic peptide
INFETRGKRGQDAMY

SEQ ID NO: 335 - protein, 15 aa, Artificial Sequence
  Description of Artificial Sequence: Synthetic peptide
ETRGKRGQDAMYEYM

SEQ ID NO: 336 - protein, 15 aa, Artificial Sequence
  Description of Artificial Sequence: Synthetic peptide
GKRGQDAMYEYMAQA

SEQ ID NO: 337 - protein, 15 aa, Artificial Sequence
  Description of Artificial Sequence: Synthetic peptide
GQDAMYEYMAQACAG

SEQ ID NO: 338 - protein, 15 aa, Artificial Sequence
  Description of Artificial Sequence: Synthetic peptide
AMYEYMAQACAGNRV

SEQ ID NO: 339 - protein, 15 aa, Artificial Sequence
  Description of Artificial Sequence: Synthetic peptide
EYMAQACAGNRVRRS

SEQ ID NO: 340 - protein, 15 aa, Artificial Sequence
  Description of Artificial Sequence: Synthetic peptide
AQACAGNRVRRSVGS

SEQ ID NO: 341 - protein, 15 aa, Artificial Sequence
  Description of Artificial Sequence: Synthetic peptide
CAGNRVRRSVGSSLS

SEQ ID NO: 342 - protein, 15 aa, Artificial Sequence
  Description of Artificial Sequence: Synthetic peptide
NRVRRSVGSSLSCIN

SEQ ID NO: 343 - protein, 15 aa, Artificial Sequence
  Description of Artificial Sequence: Synthetic peptide
RRSVGSSLSCINLDW

SEQ ID NO: 344 - protein, 15 aa, Artificial Sequence
  Description of Artificial Sequence: Synthetic peptide
VGSSLSCINLDWDVI

SEQ ID NO: 345 - protein, 15 aa, Artificial Sequence
  Description of Artificial Sequence: Synthetic peptide
SLSCINLDWDVIRDK

SEQ ID NO: 346 - protein, 15 aa, Artificial Sequence
  Description of Artificial Sequence: Synthetic peptide
CINLDWDVIRDKTKT

SEQ ID NO: 347 - protein, 15 aa, Artificial Sequence
  Description of Artificial Sequence: Synthetic peptide
LDWDVIRDKTKTKIE

SEQ ID NO: 348 - protein, 15 aa, Artificial Sequence
  Description of Artificial Sequence: Synthetic peptide
DVIRDKTKTKIESLK

SEQ ID NO: 349 - protein, 15 aa, Artificial Sequence
  Description of Artificial Sequence: Synthetic peptide
RDKTKTKIESLKEHG

SEQ ID NO: 350 - protein, 15 aa, Artificial Sequence
  Description of Artificial Sequence: Synthetic peptide
TKTKIESLKEHGPIK

SEQ ID NO: 351 - protein, 15 aa, Artificial Sequence
  Description of Artificial Sequence: Synthetic peptide
KIESLKEHGPIKNKM

SEQ ID NO: 352 - protein, 15 aa, Artificial Sequence
  Description of Artificial Sequence: Synthetic peptide
SLKEHGPIKNKMSES

SEQ ID NO: 353 - protein, 15 aa, Artificial Sequence
  Description of Artificial Sequence: Synthetic peptide
EHGPIKNKMSESPNK

SEQ ID NO: 354 - protein, 15 aa, Artificial Sequence
  Description of Artificial Sequence: Synthetic peptide
PIKNKMSESPNKTVS

SEQ ID NO: 355 - protein, 15 aa, Artificial Sequence
  Description of Artificial Sequence: Synthetic peptide
NKMSESPNKTVSEEK

SEQ ID NO: 356 - protein, 15 aa, Artificial Sequence
  Description of Artificial Sequence: Synthetic peptide
SESPNKTVSEEKAKQ

SEQ ID NO: 357 - protein, 15 aa, Artificial Sequence
  Description of Artificial Sequence: Synthetic peptide
PNKTVSEEKAKQYLE

SEQ ID NO: 358 - protein, 15 aa, Artificial Sequence
  Description of Artificial Sequence: Synthetic peptide
TVSEEKAKQYLEEFH

SEQ ID NO: 359 - protein, 15 aa, Artificial Sequence
  Description of Artificial Sequence: Synthetic peptide
EEKAKQYLEEFHQTA

SEQ ID NO: 360 - protein, 15 aa, Artificial Sequence
  Description of Artificial Sequence: Synthetic peptide
AKQYLEEFHQTALEH

SEQ ID NO: 361 - protein, 15 aa, Artificial Sequence
  Description of Artificial Sequence: Synthetic peptide
YLEEFHQTALEHPEL

SEQ ID NO: 362 - protein, 15 aa, Artificial Sequence
  Description of Artificial Sequence: Synthetic peptide
EFHQTALEHPELSEL

SEQ ID NO: 363 - protein, 15 aa, Artificial Sequence
  Description of Artificial Sequence: Synthetic peptide
QTALEHPELSELKTV

SEQ ID NO: 364 - protein, 15 aa, Artificial Sequence
  Description of Artificial Sequence: Synthetic peptide
LEHPELSELKTVTGT

SEQ ID NO: 365 - protein, 15 aa, Artificial Sequence
  Description of Artificial Sequence: Synthetic peptide
PELSELKTVTGTNPV

SEQ ID NO: 366 - protein, 15 aa, Artificial Sequence
  Description of Artificial Sequence: Synthetic peptide
SELKTVTGTNPVFAG

SEQ ID NO: 367 - protein, 15 aa, Artificial Sequence
  Description of Artificial Sequence: Synthetic peptide
KTVTGTNPVFAGANY

SEQ ID NO: 368 - protein, 15 aa, Artificial Sequence
  Description of Artificial Sequence: Synthetic peptide
TGTNPVFAGANYAAW

SEQ ID NO: 369 - protein, 15 aa, Artificial Sequence
  Description of Artificial Sequence: Synthetic peptide
NPVFAGANYAAWAVN

SEQ ID NO: 370 - protein, 15 aa, Artificial Sequence
  Description of Artificial Sequence: Synthetic peptide
FAGANYAAWAVNVAQ

SEQ ID NO: 371 - protein, 15 aa, Artificial Sequence
  Description of Artificial Sequence: Synthetic peptide
ANYAAWAVNVAQVID

SEQ ID NO: 372 - protein, 15 aa, Artificial Sequence
  Description of Artificial Sequence: Synthetic peptide
AAWAVNVAQVIDSET

SEQ ID NO: 373 - protein, 15 aa, Artificial Sequence
  Description of Artificial Sequence: Synthetic peptide
AVNVAQVIDSETADN

SEQ ID NO: 374 - protein, 15 aa, Artificial Sequence
  Description of Artificial Sequence: Synthetic peptide
VAQVIDSETADNLEK

SEQ ID NO: 375 - protein, 15 aa, Artificial Sequence
  Description of Artificial Sequence: Synthetic peptide
VIDSETADNLEKTTA

SEQ ID NO: 376 - protein, 15 aa, Artificial Sequence
  Description of Artificial Sequence: Synthetic peptide
SETADNLEKTTAALS

SEQ ID NO: 377 - protein, 15 aa, Artificial Sequence
  Description of Artificial Sequence: Synthetic peptide
ADNLEKTTAALSILP

SEQ ID NO: 378 - protein, 15 aa, Artificial Sequence
  Description of Artificial Sequence: Synthetic peptide
TTAALSILPGIGSVM

SEQ ID NO: 379 - protein, 15 aa, Artificial Sequence
  Description of Artificial Sequence: Synthetic peptide
ALSILPGIGSVMGIA

SEQ ID NO: 380 - protein, 15 aa, Artificial Sequence
  Description of Artificial Sequence: Synthetic peptide
ILPGIGSVMGIADGA

SEQ ID NO: 381 - protein, 15 aa, Artificial Sequence
  Description of Artificial Sequence: Synthetic peptide
GIGSVMGIADGAVHH

SEQ ID NO: 382 - protein, 15 aa, Artificial Sequence
  Description of Artificial Sequence: Synthetic peptide
SVMGIADGAVHHNTE

SEQ ID NO: 383 - protein, 15 aa, Artificial Sequence
  Description of Artificial Sequence: Synthetic peptide
GIADGAVHHNTEEIV

SEQ ID NO: 384 - protein, 15 aa, Artificial Sequence
  Description of Artificial Sequence: Synthetic peptide
DGAVHHNTEEIVAQS

SEQ ID NO: 385 - protein, 15 aa, Artificial Sequence
  Description of Artificial Sequence: Synthetic peptide
VHHNTEEIVAQSIAL

SEQ ID NO: 386 - protein, 15 aa, Artificial Sequence
  Description of Artificial Sequence: Synthetic peptide
NTEEIVAQSIALSSL

SEQ ID NO: 387 - protein, 15 aa, Artificial Sequence
  Description of Artificial Sequence: Synthetic peptide
EIVAQSIALSSLMVA

SEQ ID NO: 388 - protein, 15 aa, Artificial Sequence
  Description of Artificial Sequence: Synthetic peptide
AQSIALSSLMVAQAI

SEQ ID NO: 389 - protein, 15 aa, Artificial Sequence
  Description of Artificial Sequence: Synthetic peptide
IALSSLMVAQAIPLV

SEQ ID NO: 390 - protein, 15 aa, Artificial Sequence
  Description of Artificial Sequence: Synthetic peptide
SSLMVAQAIPLVGEL

SEQ ID NO: 391 - protein, 15 aa, Artificial Sequence
  Description of Artificial Sequence: Synthetic peptide
MVAQAIPLVGELVDI

SEQ ID NO: 392 - protein, 15 aa, Artificial Sequence
  Description of Artificial Sequence: Synthetic peptide
QAIPLVGELVDIGFA

SEQ ID NO: 393 - protein, 15 aa, Artificial Sequence
  Description of Artificial Sequence: Synthetic peptide
PLVGELVDIGFAAYN

SEQ ID NO: 394 - protein, 15 aa, Artificial Sequence
  Description of Artificial Sequence: Synthetic peptide
GELVDIGFAAYNFVE

SEQ ID NO: 395 - protein, 15 aa, Artificial Sequence
  Description of Artificial Sequence: Synthetic peptide
VDIGFAAYNFVESII

SEQ ID NO: 396 - protein, 15 aa, Artificial Sequence
  Description of Artificial Sequence: Synthetic peptide
GFAAYNFVESIINLF

SEQ ID NO: 397 - protein, 15 aa, Artificial Sequence
  Description of Artificial Sequence: Synthetic peptide
AYNFVESIINLFQVV

SEQ ID NO: 398 - protein, 15 aa, Artificial Sequence
  Description of Artificial Sequence: Synthetic peptide
FVESIINLFQVVHNS

SEQ ID NO: 399 - protein, 15 aa, Artificial Sequence
  Description of Artificial Sequence: Synthetic peptide
SIINLFQVVHNSYNR

SEQ ID NO: 400 - protein, 15 aa, Artificial Sequence
  Description of Artificial Sequence: Synthetic peptide
NLFQVVHNSYNRPAY

SEQ ID NO: 401 - protein, 15 aa, Artificial Sequence
  Description of Artificial Sequence: Synthetic peptide
QVVHNSYNRPAYSPG

SEQ ID NO: 402 - protein, 15 aa, Artificial Sequence
  Description of Artificial Sequence: Synthetic peptide
HNSYNRPAYSPGHKT

SEQ ID NO: 403 - protein, 15 aa, Artificial Sequence
  Description of Artificial Sequence: Synthetic peptide
YNRPAYSPGHKTHAP

SEQ ID NO: 404 - protein, 15 aa, Artificial Sequence
  Description of Artificial Sequence: Synthetic peptide
PAYSPGHKTHAPTSS

SEQ ID NO: 405 - protein, 15 aa, Artificial Sequence
  Description of Artificial Sequence: Synthetic peptide
SPGHKTHAPTSSSTK

SEQ ID NO: 406 - protein, 14 aa, Artificial Sequence
  Description of Artificial Sequence: Synthetic peptide
HKTHAPTSSSTKKT

SEQ ID NO: 407 - protein, 11 aa, Artificial Sequence
  Description of Artificial Sequence: Synthetic peptide
HAPTSSSTKKT

SEQ ID NO: 408 - protein, 6 aa, Artificial Sequence
  Description of Artificial Sequence: Synthetic peptide
HHHHHH

SEQ ID NO: 409 - protein, 398 aa, Artificial Sequence
  Description of Artificial Sequence: Synthetic polypeptide
MGADDVVDSSKSFVMENFSSYHGTKPGYVDSIQKGIQKPKSGTQGNYDDDVKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNVEQAKALSVELEINFETRGKRGQDAMYEYMAQACAGNRVRRSVGSSLSCINLDVDVIRDKTKTKIESLKEHGPIKNKMSESPNKTVSEEKAKQYLEEFHQTALEHPELSELKTVTGTNPVFAGANYAAVAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTHAPTSSSTKKT

SEQ ID NO: 410 - protein, 26 aa, Artificial Sequence
  Description of Artificial Sequence: Synthetic peptide
STNDATDANANAQNATAHKATATGAN

SEQ ID NO: 411 - protein, 389 aa, Homo sapiens
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQP

SEQ ID NO: 412 - protein, 402 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSELADYKDDDDKGLEHHHHHH

SEQ ID NO: 413 - protein, 382 aa, Artificial Sequence
  Description of Artificial Sequence: Synthetic polypeptide
MGADDVSDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 414 - protein, 382 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 415 - protein, 382 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 416 - protein, 382 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 417 - protein, 382 aa, Artificial Sequence
  Description of Artificial Sequence: Synthetic polypeptide
MGADDVVESSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 418 - protein, 382 aa, Artificial Sequence
  Description of Artificial Sequence: Synthetic polypeptide
MGADDVVNSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 419 - protein, 382 aa, Artificial Sequence
  Description of Artificial Sequence: Synthetic polypeptide
MGADDVVDASKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 420 - protein, 382 aa, Artificial Sequence
  Description of Artificial Sequence: Synthetic polypeptide
MGADDVVDGSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 421 - protein, 382 aa, Artificial Sequence
  Description of Artificial Sequence: Synthetic polypeptide
MGADDVVDTSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 422 - protein, 382 aa, Artificial Sequence
  Description of Artificial Sequence: Synthetic polypeptide
MGADDVVDSSKSFVMENFSSYHGTKPGYSDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 423 - protein, 382 aa, Artificial Sequence
  Description of Artificial Sequence: Synthetic polypeptide
MGADDVVDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 424 - protein, 382 aa, Artificial Sequence
  Description of Artificial Sequence: Synthetic polypeptide
MGADDVVDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 425 - protein, 382 aa, Artificial Sequence
  Description of Artificial Sequence: Synthetic polypeptide
MGADDVVDSSKSFVMENFSSYHGTKPGYDDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 426 - protein, 382 aa, Artificial Sequence
  Description of Artificial Sequence: Synthetic polypeptide
MGADDVVDSSKSFVMENFSSYHGTKPGYVESIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 427 - protein, 382 aa, Artificial Sequence
  Description of Artificial Sequence: Synthetic polypeptide
MGADDVVDSSKSFVMENFSSYHGTKPGYVNSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 428 - protein, 382 aa, Artificial Sequence
  Description of Artificial Sequence: Synthetic polypeptide
MGADDVVDSSKSFVMENFSSYHGTKPGYVDTIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 429 - protein, 382 aa, Artificial Sequence
  Description of Artificial Sequence: Synthetic polypeptide
MGADDVVDSSKSFVMENFSSYHGTKPGYVDGIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 430 - protein, 382 aa, Artificial Sequence
  Description of Artificial Sequence: Synthetic polypeptide
MGADDVVDSSKSFVMENFSSYHGTKPGYVDNIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 431 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVSDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 432 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 433 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVDDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 434 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIESETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 435 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 436 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDTETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 437 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDGETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 438 - protein, 382 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 439 - protein, 382 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 440 - protein, 382 aa, Artificial Sequence
  Description of Artificial Sequence: Synthetic polypeptide
MGADDVNDSSKSFVMENFSSYHGTKPGYDDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 441 - protein, 382 aa, Artificial Sequence
  Description of Artificial Sequence: Synthetic polypeptide
MGADDVTDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 442 - protein, 382 aa, Artificial Sequence
  Description of Artificial Sequence: Synthetic polypeptide
MGADDVTDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 443 - protein, 382 aa, Artificial Sequence
  Description of Artificial Sequence: Synthetic polypeptide
MGADDVTDSSKSFVMENFSSYHGTKPGYDDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 444 - protein, 402 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVNDSETADNLEKTTAALSILPGIGSVMGIADGAVHHNTEEIVAQSIALSSLMVAQAIPLVGELVDIGFAAYNFVESIINLFQVVHNSYNRPAYSELADYKDDDDKGLEHHHHHH

SEQ ID NO: 445 - protein, 402 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYSELADYKDDDDKGLEHHHHHH

SEQ ID NO: 446 - protein, 402 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDTETADNLEKTTAALSILPGIGSVMGIADGAVHHNTEEIVAQSIALSSLMVAQAIPLVGELVDIGFAAYNFVESIINLFQVVHNSYNRPAYSELADYKDDDDKGLEHHHHHH

SEQ ID NO: 447 - protein, 402 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDTETADNLEKTTAALSILPGIGSVMGIADGAVHHNTEEIVAQSIALSSLMVAQAIPLVGELVDIGFAAYNFVESIINLFQVVHNSYNRPAYSELADYKDDDDKGLEHHHHHH

SEQ ID NO: 448 - protein, 402 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYSELADYKDDDDKGLEHHHHHH

SEQ ID NO: 449 - protein, 402 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVNDSETADNLEKTTAALSILPGIGSVMGIADGAVHHNTEEIVAQSIALSSLMVAQAIPLVGELVDIGFAAYNFVESIINLFQVVHNSYNRPAYSELADYKDDDDKGLEHHHHHH

SEQ ID NO: 450 - protein, 382 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 451 - protein, 382 aa, Artificial Sequence
  Description of Artificial Sequence: Synthetic polypeptide
MGADDVTDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVNDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 452 - protein, 382 aa, Artificial Sequence
  Description of Artificial Sequence: Synthetic polypeptide
MGADDVTDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 453 - protein, 382 aa, Artificial Sequence
  Description of Artificial Sequence: Synthetic polypeptide
MGADDVTDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 454 - protein, 382 aa, Artificial Sequence
  Description of Artificial Sequence: Synthetic polypeptide
MGADDVTDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDTETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 455 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 456 - protein, 382 aa, Artificial Sequence; identical to SEQ ID NO: 413
  Description of Artificial Sequence: Synthetic polypeptide

SEQ ID NO: 457 - protein, 382 aa, Artificial Sequence; identical to SEQ ID NO: 414
  Description of Artificial Sequence: Synthetic polypeptide

SEQ ID NO: 458 - protein, 382 aa, Artificial Sequence; identical to SEQ ID NO: 415
  Description of Artificial Sequence: Synthetic polypeptide

SEQ ID NO: 459 - protein, 382 aa, Artificial Sequence; identical to SEQ ID NO: 416
  Description of Artificial Sequence: Synthetic polypeptide

SEQ ID NO: 460 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKADNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 461 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 462 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 463 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKEAGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 464 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKENGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 465 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLAEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 466 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLQEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 467 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLNEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 468 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEAIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 469 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 470 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEKIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 471 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSAEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 472 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 473 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNAEKTTAALSILPGIGSVMGIADGAVHHNTEEIVAQSIALSSLMVAQAIPLVGELVDIGFAAYNFVESIINLFQVVHNSYNRPAYS

SEQ ID NO: 474 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNNEKTTAALSILPGIGSVMGIADGAVHHNTEEIVAQSIALSSLMVAQAIPLVGELVDIGFAAYNFVESIINLFQVVHNSYNRPAYS

SEQ ID NO: 475 - protein, 382 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 476 - protein, 382 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 477 - protein, 382 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 478 - protein, 382 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKEAGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 479 - protein, 382 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKEAGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 480 - protein, 382 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKEAGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 481 - protein, 382 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 482 - protein, 382 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 483 - protein, 382 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 484 - protein, 382 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKADNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 485 - protein, 382 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKADNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 486 - protein, 382 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKADNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 487 - protein, 382 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 488 - protein, 382 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 489 - protein, 382 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 490 - protein, 382 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 491 - protein, 382 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 492 - protein, 382 aa, Artificial Sequence
  Description of Artificial Sequence: Synthetic polypeptide
MGADDVDDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 493 - protein, 382 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVNDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 494 - protein, 382 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 495 - protein, 382 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDTETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 496 - protein, 382 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDAETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 497 - protein, 382 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 498 - protein, 382 aa, Artificial Sequence
  Description of Artificial Sequence: Synthetic polypeptide
MGADDVNDSSKSFVMENFSSYHGTKPGYTDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEHIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVNDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 499 - protein, 382 aa, Artificial Sequence
  Description of Artificial Sequence: Synthetic polypeptide
MGADDVNDSSKSFVMENFSSYHGTKPGYNDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVTDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 500 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 501 - protein, 382 aa, Artificial Sequence
  Description of Artificial Sequence: Synthetic polypeptide
MGADDVVDSSKSFVDENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 502 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLDEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 503 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMDQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 504 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKAFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 505 - protein, 382 aa, Artificial Sequence
  Description of Artificial Sequence: Synthetic polypeptide
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALGILPGIGSVMGIADGAVHHNTEEIVAQSIALSSLMVAQAIPLVGELVDIGFAAYNFVESIINLFQVVHNSYNRPAYS

SEQ ID NO: 506 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKADNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 507 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKTDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 508 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLDEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 509 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMDQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 510 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKAFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 511 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 512 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALGILPGIGSVMGIADGAVHHNTEEIVAQSIALSSLMVAQAIPLVGELVDIGFAAYNFVESIINLFQVVHNSYNRPAYS

SEQ ID NO: 513 - protein, 382 aa, Artificial Sequence
  Description of Artificial Sequence: Synthetic polypeptide
MGADDVVDSSKSFVTENFSSYHGTKPGYVDSIQKGIQKPKSGTQGNYDDDWKGFYSTDNKYDAAGYSVDNENPLSGKAGGVVKVTYPGLTKVLALKTDNAETIKKELGLSLDEPLMDQVGTEEFIKAFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALGILPGIGSVMGIADGAVHHNTEEIVAQSIALSSLMVAQAIPLVGELVDIGFAAYNFVESIINLFQVVHNSYNRPAYS

SEQ ID NO: 514-543 - skipped (30 entries)

SEQ ID NO: 544 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLAEQVGTEEHIKRFGDGASRVVLSLPFAEGSSSAEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 545 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLQEQVGTEEHIKRFGDGASRVVLSLPFAEGSSSAEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 546 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLNEQVGTEEHIKRFGDGASRVVLSLPFAEGSSSAEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 547 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLAEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 548 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLQEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 549 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 550 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLAEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 551 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLQEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 552 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 553 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLAEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 554 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLQEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 555 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 556 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLNEQVGTEEHIKRFGDGASRVVLSLPFAEGSSSAEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNAEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 557 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNAEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 558 - protein, 387 aa, Artificial Sequence; identical to SEQ ID NO: 557
  Description of Artificial Sequence: Synthetic polypeptide

SEQ ID NO: 559 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNAEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 560 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLAEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNAEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 561 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNAEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 562 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLNEQVGTEEHIKRFGDGASRVVLSLPFAEGSSSAEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNNEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 563 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLQEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNNEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 564 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNNEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 565 - protein, 387 aa, Artificial Sequence
  Description of Artificial Sequence: Synthetic polypeptide
MGADDVNDSSKSFVMENFSSYHGTKPGYVDSIQKGIQKPKSGTQGNYDDDWKGFYSTDNKYDAAGYSVDNENPLSGKAGGVVKVTYPGLTKVLALKTDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNNEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 566 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLAEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNNEKTTAALSILPGIGSVMGIADGAVHHNTEEIVAQSIALSSLMVAQAIPLVGELVDIGFAAYNFVESIINLFQVVHNSYNRPAYSPGHKT

SEQ ID NO: 567 - protein, 387 aa, Artificial Sequence
  Description of Artificial Sequence: Synthetic polypeptide
MGADDVTDSSKSFVMENFSSYHGTKPGYVDSIQKGIQKPKSGTQGNYDDDWKGFYSTDNKYDAAGYSVDNENPLSGKAGGVVKVTYPGLTKVLALKDDNAETIKKENGLSLTEPLNEQVGTEEHIKRFGDGASRVVLSLPFAEGSSSTEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNNEKTTAALSILPGIGSVMGIADGAVHHNTEEIVAQSIALSSLMVAQAIPLVGELVDIGFAAYNFVESIINLFQVVHNSYNRPAYSPGHKT

What is claimed is:

1. A modified diphtheria toxin that comprises an amino acid sequence set forth as SEQ ID NO: 513.

2. The modified diphtheria toxin of claim 1, that further comprises at least one cell binding ligand from a non-diphtheria toxin polypeptide.

3. The modified diphtheria toxin of claim 2, wherein the at least one cell-binding ligand is an antibody or antigen-binding fragment thereof, a cytokine, a polypeptide, a hormone, a growth factor, or insulin.

4. The modified diphtheria toxin of claim 3, wherein the at least one cell-binding ligand is a cytokine, and the cytokine is IL-2 or IL-3.

5. The modified diphtheria toxin of claim 3, wherein the at least one cell-binding ligand is an antibody that is monoclonal, polyclonal, humanized, genetically engineered or grafted.

6. The modified diphtheria toxin of claim 3, wherein the at least one cell-binding ligand is an antigen-binding fragment of an antibody that is a Fab, a $Fab_2$, a $F(ab')_2$, a ScFv, a $(ScFv)_2$, a single chain binding polypeptide, a $V_H$ or a $V_L$.

7. A pharmaceutical composition that comprises the modified diphtheria toxin of claim 1 and a pharmaceutically acceptable excipient or carrier.

8. A pharmaceutical composition that comprises the modified diphtheria toxin of claim 2 and a pharmaceutically acceptable excipient or carrier.

* * * * *